United States Patent 10,251,921 (COMPOSITIONS COMPRISING BACTERIAL STRAINS) - sequence listing, part 2

SEQ ID NO: 5 - DNA, 3415035 bp, Blautia stercoris (residues 1,707,519-3,415,035 of 3,415,035)
  strain 830 chromosome
cgattttaaagccggtcagtgttatcagtacttctattgatcgtgtaaaaaccggggatatgcagggatatatttcaatagaaggaacaaatgaaatctggcagttagcacgggaatataatgagatgttgtgttcgattcaagaggcaaatatgaaagtagaagaacagcatggagaaattattgaatcaatgaaaatgaagcgcagggcagagagagaagcacttgaatcgcagattaatgcgcattttatctgtaatactttaaatgcgattaattatgaggcaatggataatggggattttaaagtctctttgctgcttaaaaaactttctaatattttacgctatacgtttgatcagaaacatcagaatgtgtatatgtttcaggaaatttcatggattgagcagtatctgtttttacagaaagaacgaatgggaagtgcctttgattatgaaattcagtttgattcggattatgataactggccgtgcaggaaactgatgcttcagccgtttgttgagaattcgattcttcatggattagaaggggtcaataaaggtggatttatccgaattaccggagaaggatatcaagagtatcttaaaattgtaattgaggataatggatgtggaatgaccccggaggtagaacagattattaaagaagtgttggagaatccgttgcttgcaaaacaaaaaggattgggaatcggaatttctaatgtcgtaaccagaatgaggatgtattatacagaagatttaaagattcagttagagacagaagagcgaaaaggctgtaagtttacaatgatacttccagaggcaagacagtaggagacaagggggaaggcagataaatgagaatattgatagcagaagatgaagaacgggcgaggagaggacttcattccgttttaacttctttatcagaggattatgaggtagtagcagaggcatcgaatggaaagcaggcattagagttgcttcagatcctaaagccggatgtggtttttacggacttaaagatgccatttttggatggaatgggactgattaaggcaggaattgcagcaggtgtttgcacgaaatatgtaatcgtaagcgcttatgaagaatttgaagtggcaagacaggcaatcagcctgggagtaaaagagtatctggtaaaaccagtaacttatgacgaattaaaagatacgatggaacgtctggatgcggcgcagaaaggaaagcctcagctcattgataaaacattaaaagaacggtacccggatgtgcatccattggtgagaaaatctctgggatttattgaaaaagggtattccagtaaaatcagtcagaaagagctggctgctaatcttggaatttcacaggagtatttttgttatctgtttaataaagacatgggagaaacattttctcattttttaaagaattatagaatagaagtggcaaagaagcttttattaaatggagaattgcccaaagaggaaattccgtatagtgtaggattttcagattccaaatattttaataaagtatttcgagaagtggaaggttgcacaatgacggaatacgttcggaaaaattcagaatgattcatacaaaataccagaataaatatgtgtgcactaaatgcgtgtggttaaagtgcatagtattattctggttttttgtgatctatcttaaaaaaatacccgaatcttaaaatcgtatcttaagattttacctcttatcttaagatagtaagttacgaaaaaaacctaaaattattataataataacatcttaattagaggaggaaaaaaattatgaagagaaggttccagaaaatcgcagcgctgatgctggttggtgcaatggcaggtacactggtcacaggttgtggaggcagtagctccggttcatcctcagagtcaagcagtgatagcaaagaggcgagcgacagcagttcttccaattcaaacggagcagcagaggttacgctgtggcattatttcgagcatgaagctccagaccttgaggcggtagcggagaaatacaatgagtctcaggataagattcatgttacatgtacttatgtatcccgtgaagaattgatgaaccagtacacaatcggtgcagtatcaggagagcttcctgacatcggaatggttgattcaccggatatggaatcctatatttctcttggtgtatttgaggacatcacagatgacatcaaagattgggatgaattagaccagttttatgacggacctctttcaagctgtatggatgcagatggtaaatactacggacttccaaacaattcaaactgtctgaccctttgctgtaacatggacatcttaaatgcagcaggtatcgagaacccaccaactacatgggaagaatttgaagaagcctgcaaggcaacaacaaatgcagcggaaggtgtatatggatttgcaatgtgcgatatcgctacagaagaaggtactttccagattctgccttggatttattccgcaggtggaaacattgatgatttgacaagtgctgaatcaacaaaagcagttcagttcttaactgacttagtacaaaacggttacatgagtaaagaagttgttaactggcagcagtctgatgcatacaatgcatttacaagtggtaaagcagcaatgtttgaatccggtacatggcagttagctgacattgatgagaaaatcaatggttctttcaattatcagtatactttacttccaaaagataaagaatacgcttctacaatcggtggagaaaactttggtgtctgcacaggttcggaatacaaagacgaatgtgttgacttcctgaaattccttatgaatgcagaaaacaacgcagactttacagcagcagctgcaaaacttccggttcgtaaagatgctgtaggcttaaaagacctctggacaacagatgacagatacgttgtatttaacgatgctatgaattatgcaaaagcacgaggaccgcacgctcagtggccgactctttccgaagcactttatacaggtgttcagcaggctctgcttggtgaaaaatccgtagaagacgcaatgaaagaagcgcaggctaagattgacccgattgttgcagaagatccacttcctgatttgacaacaggcggcggagttgcagacgacgtaaataagtaagaaaaaaataagcagtaataagaaagagtcctggaaccggtctgggtttcgggactcttttaaaatgaaaatcttgaaattccgtgagaggagtgtgtgaagatgaaactgaacatggctgcaaagaagaggagagaagcctatatttttattcttcccggttttatttatctggttgcaatttgtggttatcctttgatttacaatctgattttgagttttaaaaatgtaaacgtaaaaaaccttgccaccggtgcatcggtttttgttggacttgacaattataaacagctgtttgccgacccgacattccagctggtatttaaaaatacaattgaatttacactggcttgccttgtagttcagtttacaatcggctttttatttgcaatgtttttctcaaagaaatttacactggcaggaccgattcgaggtctcgtgctggtgggatatatgatgcccatgtcggttacagctttacttggtaagaacttattcttactcgatggtggtgttatcaatgacctgttaatgaaggttcatctgatttcgtccccaatcgactggctggtaaatggcggaactgcacttggagcagtcattgccgtaaactgctgggtaggtattccatttaacatgttactgttaacttccggtctgaccggcatctcaactgatatctatgaaagtgcttctatggatggagcaaatgcatttaagagatttatctacataacactgccgctgatgaaaccggctatgctttcagtattgatgcttggatttatctatacatttaaagcatttgaccttatgtacattatgacagcaggtggtccgttcaactccactgacgtacttggaacttatgcatattcaaaagcatttacccagtatgaattttcacagggttctgcaatcgcaatggtattatttgcctgcctgttcctggttgggatcttctacctgaaactgttgagtaaggaggatgactagaatgagtaaggaaagtacaaaatcagcaaaagtcgcatatctgaaatcaaaagagggacgaagcaatgtcatcaattgcttttgggcaattataatcgcaattatcttcttgttcccaatttactggctgattcagatgtcttttaagacagatatggaaagttttggaaaaatcgtaacttattatccacatgaatttaccgttgatccatggctccagaacttgcaggataaagactttattacctcattaaaaaacagtgtatccattgcactgtgttccatgtgtttatcactggtatttggtattccggctgcttatggtatggggcgttataaagtaaaaggaacaaaaagcttcatgcttacttttcttgtaactcagatgctcccggcatccgttatgttaacaccaatgtacctgattttctctaaagcaggtttacttggaacttatcttgcaccggcacttgcaatttcctccggttcggttccgtttatcgttgtaactttaagaccatactttaagagtattccggtttccctggatgaagccgcacgtattgatggatgtaatgtattccgttctttctttaagattatgattcctacaattaaaaccggtatcatcaccgtagttgttatctctttcttaaatggatggaacgatctgatttattccatgacatttaacgtaaaagcagacatgagaccattgacagcaaatatccataaattccagagtaaatacggaacaaaatggaactgtattatggcttatggtgcaatccttgttattcctgtaatccttgtatttgtattcttacagaaatacattgtaggtggtttaacagcaggtgctgtaaaagagtgatgctataaaaataataaataaaaaacaataaaaaaataaagaaaggaatcaaaactatgccagattttgtaaaaaaagagggtgcaccaacaggtgacttccgctcagacaacaactttttattaggttactttgaggaaaaagaccattctctttactaccgctatgatgcagagagagttatcattgaaccttggggagataacagtttccgtgtccgtgcatcaaaaatgcctcaaatgccggaagaactttgggcattggatggaaaaccggaaaatcgcagctctgaaattacaattaaagaatattccgcagaaatcgtaaatggaaaaattaaagcggtaatcaacaatatcggtaaaatcagcttttataatcagaaaggtgaacttctcttagaagaatatgtacgaaacagagaagatatgtttgcagaaacctgtagttctctggaagtagaggcaagagagtttaaaccgattatcggtggagattatgagttgacgatgcgttttgagtcaaatccaaatgaaaagatttacggaatgggacagtatcagcagaaattcctggatgtaaaaggtgcagaacttgaactggcacacagaaactctcaggcaagcgttccgtttgcattatcttctcttggatatggatttttatggaacaatccggcaatcggacgtgtaagcttcaataaaaatattacaacatgggaagcacgttctactaagaaactggattactggattacagcaggagatacaccggcagaaattgaagaagcttatgcagacgcaaccggaaaagttccgatgatgccggaatatggacttggattctggcagtgtaaattgcgttatcagacacaggaagaactgcttgaagtggcaagagaatataaaagaagacagattccgattgatgttatcgtagttgactttttccactggccaaaacagggtgactggagattcgacccgacttactggccagacccggatgcaatgattgcagaattaaaagaaatgggtattgaactgatggtatctatctggccgatggttgactataagagtgaaaactttgaagaaatgaaagccaaaggtctgctgaccagagtagaaaaaggtgtaagaatcgataatgtttacatgggaaataccattcagtatgacccgacaaatccggaagcaagagagtatgtatggggcaaagcaaagaaaaattattatgataaaggtgtaaaaatcttctggctcgatgaggcagaaccggaatacaccgtatatgatttcgaaaattatcgttatcacttaggaccaaacgtacagattggtaatgtttatccggcaatgtatgcaaaaacattctttgatggcatgcgagcagagggacaggaaaatgtagtcaacctgcttcgctgtgcatgggcaggaagtcagaaatatggtgcactcgtatggtccggagatattcattctacatttgaaagtcttcagaatcagtttgcggcaggtcttaacatgggactttccggtattccgtggtggacaaccgatattggtggattctttggagcaaacatctatgatgaagattatcatgaagtatttgtacgctggtttgaatatggaacattttgtcctgttatgagacttcacggttatcgtatgccatatcagccacagcttggaacaaccggtggtgcagagtgcgtatccggtgccccgaacgaaatctggtcttatggtgatgatgtttacgaaatctgtaaaaaatacattgaaattcgtgaggcaatgcgtccatacacaagagaactgatggaagctgcacatgaaaaaggaagtccggttatgagacctctgttctatgactttccggaagataaaacatgctgggataatgaatcggagtatatgtttggaccacagattttggttgcaccggttatggaacgtggacagaaaacaaaagaagtttatctgccggcaggtacaaaatggacaaacgtatggacaaaagaagtatttgaaggcggacagaccgttacagtagagacgccaattgaacagattccgttatttacaaaagaaggatttgaattagaagtataaaaagattctgatgatatgtgaaaagtaaacgggtgtgctgcactggttgccttggatgcagccggtgcagcacgttttttatgggggatatttgagatgattacacaaaaaggaaataagatttacagacgacaggataaggaattactttgtattgaaccatggggaaaaaacagtttccgtgttcgtgcgacacagcgttatgagtttgtaccggaagatatttctgctttacttcccccacaggaatgtaaagtaaaggtatttgaagaggatgactgcacggtcattgaaaatggaaaaatccgctgtgaaattacaccgaccggaaaactgcgtttcaaaaatcaggatggaaaactgttattagaagagtttgaacgaattcgtgcggattacagaaaagagtataatagtgcacttgagattgtgccaagaacgtttgagccgcatcagaatacggataatttcagattgaccgtaagatttgagccgattgacggtgaaaaattatatggaatgggacagtatcagcagccatatctggatgtaaagggctgtaccttagaattggcacagcgtaactctcaggcgagtgttccgtttgtgctttctaataatggatatggatttttatggaataatccggcaattggacaggtttctttcggaaagaatgtgacggaatggactgcagtttccacaaaacagatggattactggattacagcaggagatacaccggcagaaattgaagaggcttatgcggatgcaaccggaaaggttccgatgatgccggattacggaaccggattctggcagtgcaaactgcgctacatgactcaggatgaaatccttgaagtggcaagagaatataagagaagaaagcttccgatttctgtcattgtagtcgattatttccactggccaaatcagggtgactggaaatttgataccgatttctggccggatccgaaagcaatggtagaagaattaaaagagatggggattgaactcatggtatctatctggccgaccgtagaggaaaccagtgaaaattataaagagatggaagaactgggttatctgactcgttccgaacatggaaaacgtcttggacagcttaatgtggcaagtgtgattgatgtaaccaatccagacgcaagaaaatacgtgtgggaaaaaattaagaaaaattattatgatttaggaatcaaaattttctggttagatgaggcagagccggaactgaccggatatgaattcagtcattaccgttatttccgcggtgcagatatggaagttggaaatatgtatccgaaagaatatgcacgtatggcttatgaaggcatggaagaagaaggtcaggaaaatattgtaaatctgcttcgctgtgcatgggcaggaagccagaaatatggtacattggtatggtccggagatattgattcttccttccgttctttaagaagccagcttgcagctggtttgaatatgggaatttccggattgccatggtggacaactgatatcggaggctttcacggtggaaatattaacgatgaaaaatttaaagaagtgctggtgcgctggtttgagtttggagcattttgtccggttatgcgtctgcatggattcagagaaccgtttatcccaggtttaagtgaatccggcggtggaaaacacaggagtggttctccaaatgaagtatggacttatggtgatgaagtacttagaatctgtacaaaatatcttgaattaagagaaactatccgtccttatgtaacagaactgatgaaagaagcacatgaaaaaggaacaccggtgatgcgtccattattctatgattatccggaagatacaaaagtctgggaaatcgaagatgaatacatgtttggaccagatatgctggttgcaccgattttatatgaagatatgagagaaagaaccttgtatctgccagaaggagactgggtcgatatcaactccaaaacagaatataagggcggagattttgtgaccgtagcagctccgcttgatacccttccggtatttgtaaagagaggaacacatccggaactggtataacagaaacttaaaacaggttataagaaagagggctggaatcaaatgaaaaagacggaaaatatgtttggatttggaggaagttttgtagggacagtagagaaaatatttgacataatggcattaggatttctctggattctttgcagccttccggtcattaccataggtgcatctactacggcactgtattatgcgatggtaaaatcagtaaaaaataatgatgggtatgtgacgaaagaatttttccgttcttttaagttaaactttattccagccacaattttatggatgattcttgcagtgatgacatttatcatgcagttaaatgtaggaatcttaatgaagaaaagcagtggcatggtggggctgttttttatctgcttttatgcactggtatcggtttatctgattattgtggcatgttatgcatttccggcactttccagatttgatatgaatgtcggatggattttgaaaatttcaatgtacatggtcgtgcgttatatttttaccagtatcatgcttgtaattatactggtctgcattggtgcaatcgtctggaaactcccgctgctggtgttctttgtgccaggaccgattgcgtttttgatgtcagaatttttagagcgggtgctcaaaaaacatgaaccgaaagtagaagaaggaggaacagcagaatgaaatttaccaatggatattggatgttaagagatgaaatagaagcttcttatgcagtagaatatgcaaaacatactgtaaatggaaataaattagaggtatatcttccggcaaaacacatgtcaggaagaggggatgcgctgaatattgcacttcttacattgacgctttccagtcctcaggagggtgttatcaaagtatcagcggttcatcataagggaatgccttataaaggaccgtttgcagcagtaaaaaatgaaaatccaaatgtcacaattgaagatacagaagaccagctgatttataagagcggtacattaaaagcagtcattgataaggctccaaatgcatataaactggcattttatgagggcgatacattcttaacagaatccagtttcagaaaccttgcttacatgcataaccgtgaaaccggaaagaattatatggtagagcagctcctgctcgatgtaggcgagtatgtttacggacttggcgaacgtttcactccgtttgtaaaaaatggacagattgtagaaatgtggaacgaagatggcggaacggcaagtgagattgcttacaaaaacattccgttctatattacaaataaaggttacggcgttttggttgacaatgagggtgacgttgcttacgaaatcggaagtgaaaaagtagaacgagtacagttctctgtagaatctgaaagactggattactattttatcagcggaaaaactccgatgggaacagtagaaaaatatacagaattaaccggaaaaccggcactgcctccggcatggtcctttggtctgtggctgactacttcctttacaacagattatgatgaaaatacaacctccggttttattcagggaatggcagacagagacattccgcttcatgtattccactttgactgctactggatggaacggtttaaatggtgcaatttccagtgggatcatgaggtaacaacagacccgaaaggaatgttaaaacgctatcatgacaaagggttaaaaatttgtgtatggattaatccatatattggacagcagtccgaattgtttgaagagggaatggaacatggctatttcatcaaacgtatagatggaagtgtatggcagactgatttatggcagccgggaatggcagttgtagactttaccaatccggaagcatgcaaatggtaccagagcaaattaaaagcactgcttgatgatggggtagactgctttaagacagactttggtgagagaatcccggtaaaaggaattcagtattatgatggttctgacccggttaaaatgcataactactttacattcttatataataaggctgtatttgaagtacttgaaaaagaaagaggaaaaggcgaagcagttttatttgcccgttccgcaacggtaggcggacagcagttcccagcacattggggtggagactgctctgcaacttatgtatcaatggcagaaacccttcgaggcggactttccctttctgcgggtggatttggattctggagtcatgatatcagtggatttgagcagactgctccggcagatatctataagagatggtgtcagtttggactgctttcttctcatagccgtctgcatggttcttcttcttaccgtgtgccgtggttatttgatgaagaatcctgtgttatcttaaaagaatttgtaaacttaaaatgtcgtctgatgccgtatatctatgagcaagcggtaaaagcacataaaaacggaacaccggtgctgcgtccgatgatgctggaattttcagaagacagagcctgcgactgccttgatttacagtatatgtttggtccgtctcttttagttgctcctgtcttcaaagaaagtggagaagtaagttactatctgccaaaaggaacctggattaacctgattacaggagaaaagaaagagggcggaacatggataaaagaaacgcatgattatcattctcttccactgatggttcgtgaaaataccatccttccgatgggagcaagcgagacagaagcagaatatgattatgccgatggtgttacacttgtactttctgaattttcagatggagcaagtgcagaagtagaaattccggatacaaaaggaaatacagttatgaaagcttatgcagtccgcaaaggcgatgaaatcgaagtttctgtagaaggcagaaatggtaactttactgtgaaaaatcttggaagcggaacagttgttgtaaaataattacggtttctattctataataaaagtatgtaataccatacgatgcgacttgacaatttgtttgtcaagtcgtattttattttataagaaataagaaaaattttatcattaagacattggcaactatcgttaaatatgttacaataatgttacaaaaaaattaaaaaggtgagaaaatgaatttatatgaagcgatatttttaagaaaatcagtacgaaattatgagatggaagcactcaaaccatcactgcttactgagataaaagattattgtaaacagatagagggattaaatccaggaattaccacggatatttcaattatagataataccaaaggacagtataagagagttcatctgctgggagtaaaagccccgtattatctggcgttttattcagaagataaagataaggcaatgttaaatgcaggatacattttagaacagttagccttgtttttatgtacaaaggggcttggaacgtgtttccttggaaatgtaaaaccaaagtttggaaataccaataaaggaaatatgaaatgcatgattatgatggcatttggaaagagccggggggcacataccagaaagccgtcagaggcaaaacgaatgagccttcaggaactctgcgtttataaagaagtaccgcggcagtgggtgaaacagcttttagaggcagcaagacttgcaccgtcaagcatgaacagtcagccatggcgttttgtggtctatgacaaccggattcacgtattttcaaagaagcataatatcacttattttggtatgggaaaatatgatgaatttaatctgggtgtgatgttttcacacttaatgattgtagcagaagaactctggctggatttggatttgattcgtctggaggatatttcacataagaatttttcaaattgtgattatgtgatgagtgccgtactgcgaacctgataaaaagaaaaaagaaacgtactcaatcgatagaagaaagagtacgtttcttttttgtattttgattataatacgatggaaaaaattttgtttgtttaaacaaaaagagcgcgagacgggactcgaacccgcggcctcgaccttggcaaggtcgcgctccaccaactgagccactcgcgcatgtcttaacgacaagtgatagtatactatagagatatgagaatgtcaatactttttttgaaaaaatttagaaaatagaatttgttactttattggaaaaaaggatatgaatgtggtatactaaagaccagaaattcagagacttaaaataacctttaatcaaggaggaattccgttatgaagatgatatttgcaattgtgcacaaagaagatgaaggatttgtagtagaacgtctgaataaagaacatatcagtgtgacaaaactttccagtacaggtggatttatgagaaaaggaaataccacactgatgattggaacagaggatgaaaaagtagacactgcaattcagattattaaagaagagtgttcaagaagaaaagaaatgcttgtgccgacaccaacttattctgagggaacaagagcaccgatactgggatattcctcaccgcaggtcacggttgatgtgggcggtgcaaccgtatttgttgtagatgtagaacagtttttaaaattatgatgtgagtgtcaaaagtagaaagaatagatagaaaagcagagaaaggaagaaaataatcatggtaagaaaaacaaatgtagtggtacagcaaaatgtcagaggaggggaaggaaccgtagagtttcatcacattcttgcagaagaagaattatatggacatggaaagctttatgcgaaagtagtgttaaaaccacacagctcaatcggtatgcatcagcatgttggaaataccgaaccatactttgttttaaaaggaacaggagtatttgtggataatgatggaagtcgtaccgaagtgcatgaaggagatgtttgtgtgattgaaccgggacagagccacagcatggaaaataatacggatgaagactttgagatgatggctttaatctataacgaagcagcaaaataatgtcacaaattctaaacgaaagtgtgcttgtaaaaccgccgttataatgatattataattagataactattatatcatttacaaagcggaggaacttaggatgaaaaaattaaaagtagtaaaaggcgcaaaatgtatggcatgtctggagtgtgtaagagcctgttcaacaagtttttacaaagaatttgacccagacaaatcctgcatccagattattgacaaaaatggtgacgcaaaacctatggtttgtgttcaatgtggaaaatgtgaaaaagcctgtccagagggtgcaattacacagaatgcaaaaggcgtttacatgattaacaagaaaaaatgtaccggatgtggaaaatgtgtggaagcctgtccatttaatgtcatggtgaaagcggaagaatcaccggttacaagcaaatgtatcgcttgtggaatttgtgcaaaagcctgtccaatggatgttcttgaagtagtagaagactaatagatattgtattagtgtacttgacacattacacgaatcatgaatggtggctgccgcagtttgtctgccggcagtcatttttttctatttaagcatgttaatactaattttaatttgaagtaagtccgctttttgtttcgtgaggtgaacgatgataaaaaaatatgaaacgtcaatctgttccaatcaggatggattagagttatccgttttatggttagaaccggaaaaagaaccgaaaggaatcttacagatttctcatgggatgagtgaatataaagaacgctatcttccatttatgcgatatttatgtgaacgagggtatctctgtgccatccatgaccatagaggacatggaaaaagcgtaaaatataaaagtgatttaggatatatgtacggaggaaaagacgatgcgctggtggcggatttgcatcaggtaagtgtgtggttaaaagacagatatccaaatcttccattttatatgctgggacacagcatgggaagtctgattgccagaaactatttaaaacaatatgactatgaattggaaaaattgattttaacaggaccgccttgtgaaaatccggctgctgatcttgggcttttgatttcgagagcagagaagcgggtttccggtgcacatcacaagagtaaactgttggaattaatggcatttggtccttatgcattgaaatttaagggagaatccagccgttcttcctgggtgtgttccgataaagaagtggtaagaaaatatgatgaatcggaatactgtggttttacgttttctgcggatgcatttgagagcttaatgcttctaatgaaagaaacatacagcaaaaaaggctggaaattaaaaaataaagaactgccggttctgtttttggcaggggcagatgacccatgtgcaggaggcggacgaaaatttgtaaaagaacttcagtttatgaaatccattggataccggaaagtaaccggaaagatgtatccggatatgcgccatgaaattttaaatgagactaaaaaagaactggtgtatgaaaatatatacgagtatctggaaaggaaaaatagaagataaaatatgtcaacaaaatcagaagttctgaagcttttagaagaaaataaggggacttatctttccggagaagaactggccataaaactgggctgttcaagaacggcaatctggaaagcgatgaaaacgctccgtgaagaaggatatgagattttggcagtcaataatcggggatatgcattaagtaaagaaaataatgtattatccgaggaagcaatccgacttgggcttaataaaaaagcggtaagaatagaagtaaaaagagaaattccatcgacgaaccagtatttaaaacaaaaaggaatcgaagaagaatacgaagaaggttcggtggttgtggcagagagtcagagtgccggaaaaggcagacgaggacgacatttttattctcccggaaaatgtggactttacatgagcgttttattaaaaccgaaaaaaacggcacaggaaagtttaaagattacagcagcggcggctgttgctgtttgcagggcggtggaaaaagtatgcaaggtgtctcttggaattaaatgggtgaacgatttatatctgggagagaaaaaagtctgcggtattttaacagaggcagtcagtgactttgaaaccggagatattgaactggttgtagtgggaattggaataaacttaaaagaaccgaaagatggatttcccaaagaactcggagatattgcaggaacagttttaaaagagggagagcatgtagaccggaatcttctggttgcagaaatcgtaaatgaattgttagaagagtccgaaaaagatggaatcccgaaagagtacatcgaaagaaatattgtgccgggacgaaaggtctgggtagcatatggacaacaggagaggagtgtgttcgcaaagcagattcttacagacggccgtctgttaattgaaaacgagcaacatgaagaagagattctgccttgcggggatgtgtctttacgaatccgaaggatgtaaaaagccgtgacaggtaatctggataaataaaataccgataaaagcaccgatactgtcaattccgacatcacgcttggaaggacctcttccatccacgaaggattgatgaaattcgtctgtgcaggcgaaaccgacactgataagtccggcaagcagaatcaaccagattccacggacaccatagacataaagcggaagcgaaacacaaagcgcaagaataaagtattcggtcatgtgggcagcttttcgaaccggaaattccagtttatcggtgtaatactggattcttgtctcatcaagatttttgtcgagcgccttatcggcaacgacaacgatttcacggctgattttctggcttaaagcaccagactgcgctccgctctgtcctgagaaggaaaagattaaatacatcatgcaaagggcaggaatgaaagagagcggttttaaaagtaatataaaaaactttttcataagaatgatcctttcttaaaactttgaactatcataagtgttaataggttagattagactatagcacgtttggctatggatgtaaataaagagaaaaaactaaaaaagcattagaaaagaggaaaacatgagttacgcagatgaattatttgtaaaaatgtgccgtgatattttggataacggtacagatacaaagggcgaaaaagtccgcccgaaatgggaagataccaatgaaagtgcttatacaatcaaacgatttggagtggtaaaccgctacgatttaagaaaagaatttccggcgctgacgcttagaaaaactgcattaaagagctgtatggatgaaattttatggatttatcagaaaaaatccaataatgtcaatgatttacattctcatatttgggatgcctgggcagacgaaaatggttcaattggaacctgctatggagatgtcgtaggacgaaaatttatttataaagaagaagaaacggaccagatggattatgtgcttcgccagttaaaagaaaatccttacagcagacgaatcatgaccaatctctatcagtttgaatatctgcacagcggagcattagatccgtgttgttacagcatgacttatagcgtgacaaaagagccgggagaagaacgtctgattttaaatggagtgttaaatcagcgttcccaggatgtgcttgcggccaataactggaacgtgtgtcagtatgcaattttgcttatgatggtggcacaggtcaatgatatgattcccggagaactggtgcatgtgattgccgatgcgcatatttatgaccgccatgtgcctgtaattgaagaattaattaaaagagaacagtatccggcaccaaaagtttccttaaatccggaagtgaaagatttttataaatttactaccgatgatttgattgtagaggattatcaggcaggagaacagattaaaaatattccgattgcggtataagaagaaaatagaaagacagaggagagattaaagttatgaatattattgtagcagtagataaaaattgggcgattgggaaagaaaacaaactgttggtgagtattccggcagatatgaaatttttccgcagtaccacgaccggaaaagtagttgtgatgggaagaaaaactttagaaagctttccaaatggactgcctcttaagaatcgtacaaatattgtactgacaaaagacaaaaactataaagtaaaagatgcgattatcgtacacagtatagaagaagcactcgaagaattaaaaaattatgcttctgaagatgtgtatgtaatcggaggagacagtatttatgcacagatgcttccttactgcgataccgctcatgtgaccaaaattgatttcggatatgaagcagatgcatggttcccgaatctggatgaaaatgaagaatggaaaattgcagaggaaagcgaagaacagacttactttaatctggaatattcttttgtgaagtatgtgagaaaataaaataaaaaaatccgctggcagttaaaattctgtcagcggattttttatgaaaaaaattaattattcgattacttttaaccatccttctggagcttcgatgcgtcccatctggattcctgttaatgtttcgtataatttctgagtagtcggtcccattttttccattccggaagggaatacgatttcttttccatggtcaacaatcttaccaaccggtgagataacagcagcagtaccgcaaagaccacattctgcgaaatcttttacttcgtcgagataaacttctctttcttctactttcagtccaagataatgttctgcaacataaagcagggaacgtcttgtgatagatggaagaatactgttagattttggagtaacaacagtgttgtcttttgtgacaaacaggaagtttgctccacctgtttcttctacttttgttcttgttgctgcatcaagatacatgttttcatcataaccctgattgtgagcatcaacgattgcatgtaagctcattgcgtagtttaatccggctttgatatgtcctgttccatgaggtgcagcacggtcaaaatcactgacacggattgtaatcggttttgcaccgcctttgaagtaaggtcctactggtgtagtaaatacacggaactgatattcatttgcaggtttaacaccgataacagcgtcagaaccaaacatgtaaggacggatatataaagttgcaccagaaccataaggtggaacataagcagcgtttgcttttacagtttcaacaacggcttcaacgaaacggtcttctgggaataccggcatttccagacgttttgcagaatctaccatacgagctgcgtttaagtcaggacggaatgttacaatgtgtccatcttctgttgtataagctttcataccttcaaaaacagtctgcgcatactgaagaactccggcacattcgcttaaggtgatggtatcgtctgttgtaagaccgccttcatcccatgctccatttttaaaatttgaaacataacgataatctgtttttacataaccaaatccaaggctggaccagtcgatgttttttttctccatttgaatctcctccattctttgcccattgatacgataggtaactataaatttgttttccattataaaactttaatgcgggaaatgcaagagaagttacattgcttttttaagtcatatcagatataattgaaatcagttctggtaagggcaggattggagtgagagaatatgccaaagaatgattggaaccaacttggaaatgatataaaaaatattgtgcaggatgcaattgagacaggagattatgggcgcttaaatcgtgatttaggtgtaacgcttgagaatgcgctgggaaatatggcgacgagtgtgaaagatgctgcaataaaaaatctgaatcatttttcaggtagtcagcagacagcaaatcagagaagaactgtttcaccggaaagacaaagacaagagcagaatatgcggggatataaaaagaaactggtgaaagaagccagagaaaaattcgccctgtatgtcaatacttcaactccgagagcacttggaattttatttacgacacttggaattgcacttgtgggaatgtttggagtgacggctgcaacgcttgggattgcaggaatctttattgacgcagttgcaaataagatgcaaagaggaatgtttgtatttatagctgcgatagtggcaagtggagcgcttggcatttatggaaatacgcttcgtaaaaaagtgaatcgcttccgttcttatgtacggactttaaatggaaagacttatgttaaaattgaggagcttgcaaaaggcgtaagaaaatctccaaaatttgtaaaacgggatttgaagaaaatgattaaaaaccgtatgttcttagaagggcatctggatgaagagggaaattatctgattaccagtgatgagtcttatgaacagtatatgcagacaaagaaagcatctgagattcaggaaagagagatgcaggaaaaagaacaggcagaacagaaactgcggggaactctttcagaagaagtgcaggaagtcatcaaagaaggggaagcttacttagaagaaattcgaagctgcaatgaagcaattccgggtgtggaaatttccaataaaatgtatcatctggagaatgtgattttaagaatcttcaagcgggtggaacagcatccggagctgatttcggacctgcataaatttatggattattatcttccgacgaccgttaaattgttgaaagcttatgaagaactcgacaaacagccggttgaaggagagaatattaaaacagcgaaacaggaaattgaaaatacactggatacgatcaatgaagcatttgaaaatcttctggacagcttttttagaaatacggcatgggatgtatcgactgatatttctgttttaaagaccatgctggcacaggaaggactgacaggaaataaggactttgaaagtgtatccggaaaggaaaactaaatgagcgatgaatttaaagaatttgatgtgacaccgacacttacttttggggtggaagaagaaaaacctgtcccgaaagaaccggaaaaaccgacggatccaaatatgactgaagacgtattgtcggcggaagaacgccagatggtggaaagtttttccaagcagattgatatccgcaattctgctgcaatcttgcagtacggagtgggaacgcagaaaaaaatggcagatttttcagaagaagcactcgcaaaagtaacaacaaaagaccttggagaagttggtgatttgcttgaaaatgttgtgaaagaactgaagagttttgatgcggtggaagaagaaaaaggtctgtttggaatctttaaacgtggcacgaataaaattcaggcattaaaaacgaagtatgccaaagcagaaggaaatatcgaacagattgtgcagacactggaaaaacatcagattcagcttttaaaggattcagcgactatggataaaatgtatgcactgaatttgaattattttaaggaactttccatgtatatcttagcaggaaagaagaagctgcaagaagtgcgagaaggtgagttaaaagaactgactttaaaagcacagatgagcaatctgccggaagatgcacaggcggcaaaagatctggattcaatgtgccagcggtttgaaaagaagattcatgacttggaattaacccgtatgatttcgattcagacggcaccgcagattcgtctggtgcagggaaatgataccttaatggcggagaagattcagtctacgcttgtcaacacgattccactctggaagagtcagatggtactggcacttggagtggcacatgcatctcaggcagcaaaggcacaaagagaagtcaccgatatgacgaatgccctgcttcgcaaaaatgcagagacattgaagatggcaaccattgatgcggcaaaagagtctgagcgtggaattgtggatatcgaaacattaaaacatacaaatgagaatttaatcagcacctttgatgaaattatgaatatccagaaagagggtcatcagcagagaatggaagcagaagctgagatgaaccgcttagaagaagaattaaagaaaaaactattggaaatcaatcattaatttttggaggcgaaggtagatgtatcgtgacaatacaaaagtagtttcaattggagacagaaaaatcggtggtggaaatccgattttaattcagtccatgacaaataccaagacagaagatgtcgaggcgaccgtagcgcagattttggagttagaagcagcaggatgtgagattgtccgctgtaccgttccgactttagaagcagcaaaggcattaaaagaaattaaaaaacagattcatattccactggttgcggatattcattttgattataaaatggcaattgcagcgatggaaaacggagccgataaaatccgaattaacccgggaaatatcggaagttcggaaaagattaaagccgttgtagatactgcgaaagccagaaatattccaattcgtgtcggtgtcaattccggttcactcgaaaaagaactggttgaaaaataccatggagtcacagcagaaggactggtagaaagtgcacttgataaagtgcgaattatcgaggactttggttatgacaatttagtaatcagtatcaaatcttcggatgttatgatgtgcgtaaaggcgcatgaactgctggcaaaacagaccaattatccactgcatgtcggaattacagaagccggtactttatactccggaaatatcaaatccgcagtcggacttggaattattttatatgaaggaatcggagataccattcgtgtttctctgacaggagatccggttgaggaaatcaaatctgcaaaaagaattttaaagaccttaaatttaagaaaaggcggaattgaagtcgtatcatgtccaacctgtggacgtacccagattgatttgattggtctggcaaacaaggttgagacgatggttcagcagtttgatttagatatcaaagtggcagtaatgggttgtgtggtaaatggtcctggcgaggcgaaagaagcagaccttggaatcgcaggaggaaaaggtgtgggtcttttgattaaaaaaggagaaatcgtaaggaaagtgccggaagctgaattgcttgataccttaagagaagaactggaacactgggcgaaataatccgttcctatttataataagcaaatgatgagaacttgtattggatggaatagaagaaaggaagcatatcaatggaaaaagatttcttagaagtcttttcaggtcttgaagtagaaaaagaattaaaggcacttttagaagatgtgaaagtgacgaagattgcagtcaatccgaaaaaagaccgtatgagagtttacattcagagcatacagtggattcagaaaaaatacatctatgctctggaaaagcagataaagaaacagttttttgcttcagcgcagatacagataaaaattattgaaaaatttacgctgacctctcagtatacgccaaagcttttctttgaagcctaccgctcttctatgttagatgaactaagagggcacagtattttaatttataatacctttcgtactgcgaaaattgaatttccggaagaaaacaaaatgaaacttgtcatgcagtcctctgtactggcaaaaagtcatgaggaagaattgatttcttatattgaaaaaatcttctgtgaaagatgtgcattctctctgattgtagagccggaatatgaagaagcaggcgaaagtaagatacgcaaaaacagcgaaatacgaattatgcaggaggctgctcatgtcattgagcagtcttctttcgggcatgtaaaagatgaggccgaagagggcacagaaagcgaagcaaatcagccatacacaacaaaagaagagaaaaaagaaagcaagaaagaaagcaagaaagaaaacaaaaaagaaaaacagacggaatcaaaaacgaaaaaagaaaatacaaaagaaaaaagatttacgcaaaactccgaatacagacgtggcgtgaaacgttccgataatccggatgtgatttatggaagagattttgatgatgaggtcattccgttaagttcggttcagacagagatgggtgaggtctgcatccgtggacagattatgagtttggatacccgtgccatccgtggtgaaaaaacaattattatgtttgcgattacggattttacggattcgattatgataaagctgtttgccaaaaatgaacacgtagatgaaatcttagagggcgtaaaagttaaaaactttattaaattaaaaggtgtcaccaacattgaccgtttcgacagcgagcttacgattgcgtctgttgccggaatcaagaaaattgcaccatttacttcttcgagaatggataccagtccggaaaaacgagtggaacttcactgtcataccaagatgagtgatatggatggggtttccgatgcaaaacagattatcaaacaggcgtatgaatggggacataaagcgattgcaattaccgaccacggggttgttcaggcgttcccggaggcaaaccactgctttgatgagtggggcggagttgtgccaaaagatgcggattttaaagtcatttatggaatggaagcctatctggtcgatgatttgaaaggaattgtacaaaacagtaagggacaaccgcttagaggaaaatacgtggtctttgatattgaaaccaccggattttcggcaatggcagataagattattgaaatcggtgcggttcgtgtggaaaacggaatcatcaccggacgtttttctgagtttgtaaatccgaagattccgattccatttcggattgaaaagctgaccagcatcaatgacagtatggtggcaggggcagaaaccattgataccttgcttccaaagtttattgaattttgcgagggcgcagttatggttgcccacaatgcggaatttgatatgagttttattcagaaaaactgtaatgatttaggaattgagacagactttactttcgtagataccgtgggaatggcgagattcttactgccacagttaaatcgttttaaacttgacaccgtagcaaaagcggttggagtttctctggaccatcatcaccgtgcggttgatgatgcagaatgtaccgccggaattttcctgcgctttatcgagatgtgtaaggaaagagatattgaaaatctggatgatttgaatgaaaaaggagcagtttctgtcaatgccatccagaaaatgccgacctatcatgccattattctggcaaccaatgatatcggacgtgtcaacctctatcatctggtatcggattcgcatttgatttattatcacaggcggccgagagttccaaaaagcgtgtatctaaaatatcaggaaggcttactgattggttccgcctgtgaagccggagaattgtatcaggcagtgttaaacggcagaccggagccggaaattgcaagactggtaaatttctatgattatctcgaaatccagccggtcggaaacaatgaatttatgattcgtgatgaggatcgtggcgatatcaacagcgaagacgacctgcgtgaaatcaatcgaaagattgtaaaactaggagaattatttaataaaccggtcgttgcaacctgtgatgtacactttttagacccggaggatgaaatctaccgccgaataatcatggcaggaaagggatttgatgatgcagatatgcagccaccgctttacctgcatactactgaggaaatgcttcaggaattttcctatctgggaagcgaaaaagccgaagaagttgtaattaccaatccaaataagattgcagatatggtagaaaagatttctccgattcataaaggaaaatgtccgcctgttatcgaaaattccgatgggatgcttcgagaaatctgttataacaaggcgcatgaaatttatggcgatactcttcctgaagtggtagaagaacgcctggacagggaattaaattccattatttccaatggatatgcggttatgtatatgattgcacagaagctggtgtggaagagtaacagcgatggttatctggtaggttcaagaggttcggttggttcttcttttgcggcaacgatgtctggaattaccgaagtaaatccattaagtccgcattattactgttcttcctgtcattatagcgattttgattcggaggatgtaaaggcttactcaggacgtgccggatgtgacatgccggataagatctgtccggtctgcggaaaaccattaattaaggaaggatttgatatcccatttgagaccttccttggatttaaaggggataaagagccggatattgacttgaacttctcaggagattatcagggaaaggcgcaccgctacgttgaggttatctttggagcaggacagacattcaaagccggaacgattggaacacttgcagagaaaactgcatttggttatgtgaaaaattattttgaagagcgcggagaccgcaaacgaaactgcgaaatcacaagaattgtacagggatgtaccggagtcagacgaacgacaggtcagcaccctggaggaatcattgtacttccgattggctgggatatcgaagaatttacaccggttcagcatccggcaaatgatatgacaagtgatattattacgacgcattttgattatcactccatcgactcaaacttattaaaactggatatactcggacacgatgatccgaccatgattcgtatgcttgaggacttgaccggaatcaatgcaagagagattccgctggacagcaaagaagttatgtcattatttaaaagtacggatgcacttggcattacatcggaagatatcagaggttgtccgcttggctgtcttggaatcccggagtttggaaccgactttgcgatgcagatgttaattgacgcaaacccgacttccttttcagatttggtgcgtatttctggtctgtctcatggtacagacgtatggcttggaaatgcgcaggatttgattaaatcgggtactgcgaccattactacctgtatctgtacccgagatgatatcatgatttatctgatcaataaggggctggaacatggacaggcatttaccattatggaaagtgtacgaaaaggaaaaggtttaaaaccggactggatagaagaaatgaagtcacacggagtgccggactggtatattgaatcctgtaagaaaatcaagtacatgttcccgaaagcacatgcggcagcctacgttatgatgggatggcgaattgcatactgtaaaatatattatccactggcatattatgcggcatatttcagtatccgtgcgaccgcattttcttatgaactgatgtgtcagggaaaagaaaaactggaatattttatggatgattatgaaaagcgaaaagatactttaagtaaaaaagagcaggatacgcagaaagatatgaagattgttcaggaaatgtatgccagaggatttgaatttgtgccgattgatttatataaggcaaatgcgcatacgttccagattatagatggaaaattgatgccggctcttgatacgattgaaggacttggagaccgtgccgcagatgcggttgtgctggcagcggaagatggagcatttttatcaaaagatgactttagaaatcgtacgaaagtcagcaagacggtaattgagttaatgtcggatttgggactgttcggagatttaccggaatccaatcagatgtcgttgtttgattttcagtaaaaaatattaaaacgagtaagtaaagaaaaaaggaagacaaaggttatgaattatcaggaagcaagagcatttttagatgaagtaggaaaaagcggaagcgtgcttggactggaaggaatgaaagaactattaagacgtctggataatccgcaggacaagctgaaatttattcatatttctggaacaaatggaaagggctcagagctggcatttctttcagaaattttgacaaaaagtggataccgtaccggaagatacatttctccgacgctgtattcttatcgtgaacgcatccaggtagataaagaaatgatagaccgtgattctctggcaaaacttacgacaaaagtaaaagaggcagtggacgggatgctttcagatggattacagagtccgaccgtctttgaagtagaaacagcgatttcatttttatattttgtagaaaagcagtgcgatatcgttgtattagaaaccggactgggcggaacactggatgcgacaaatgtggtaacaacaaccgtgctcgaagtgattgcttcgattggaatggatcatatgatgttccttggaaatacgcttggagagattgcaaaaaataaagccggaattattaaaccgaatacagttgtggtatcggcaaaacaggagccggaagcagaagaggttgtaaagaaagtcagcgaggaaaaacatgcaacgctctcgattgtaaatccggaggaaatcaaagacgttcattatggatatgaaacacaacgcttttcttataaaaactggaaagacatcgaaatttctcttgcaggaacgtatcagataaaaaatgcagcacttgcactcgaagcagtggagacacttcgaagtcttggctatcagttaagtgaagaaacggtacgaaaaggaatgaaagaagcgacatggagaggacgcttctctgtcattcataaagacccggtggtagtcattgacggagcacataatccggcagcggcaactgtcttaaaagaatccttagaaacttattttaaaggaaaaaacctgtattacatctttggggtatttgcggataaagactatgaaaaagtcattgaactgactgcgccgcttgcaaaacagattgtgacggtgcagacaccaaataatccaagagcactgccggcagaagaactgaaaaaagcagtagaaaaagtgaatccgaatgtaaaagcggcaaaaagtgtggcagaagcagtggaagaagtaaaagcaatgacgacaaaagatgatgtagtgattgtatttgggtcactttcttttttgagtttggcggatgaggcatggaatcggtagataaattttgaaaaaaatatttggctaaactgtttgaaaattaaatctataattgttatagaggagattaaaaaatgtataaagtaaaattttttagtggatatgaagggaaaaattttattgggttaagtccagaagaagtaataaaaaatatgtccgattttgaggaaacgttttatggtgggaagaataaagaaattcgacgagatatttcaaaagatattatagcgtattatgacaagaaaaataaaatttgtgaagcaatacagtttgtaaacgagcatacagatatatatgttaatggagttcagcttatgcgtgttccagaagaagaggttattccaacattaagaaaagtttttccaggagaagaagggtttaccgatggttcaaattatatgtatatgaaatatgcatttagtgtgtttgtgacagaggggcaggtatatggagtaactgtggggaagaaaaactattttgatttttggaaagaagatttagaagacttaggtcattctggattaatgaaattttaagagaagagagattgaaatatgaaaaaaatagttaaaatcatacttcctgttgttatcgtagcagcgggatttggaatgttcaagtattcgcagaaatccctccaatctgaatcagcaaaggaacaaaaagaagcatcaaaggaaacgtcaaaagaatcagaacaaacagatgaggatgaaaagacaagtcaggactatgaaggaatccaatatgatgaagatggtttcatgatgagtccggatgaattaaatgcagaccttccagaatcgacttatgaagagatagaggcagacggagcatatgaagaagcgatggatgcagaacaggaagaagaagagaatgaaattcatttcgatgatggaacggcaacggatatctcagattctgttacaatagagtcctatccggaatacagttcagatatcagtagtgattcggatttatcaggcgagaatcctgcttcttttttcatgagcggagaatagaaagggtcaattgtatacaatttatggtttttctggaaaatttgaataaaatttcataaaaatcactaataaacctagctaaaaaagcaattttgtggtacatttaataagtaagtatttagaggcttatttacctgattcttttcgttcttttttgttgcggagctgaaaggaacgaatcgaatcagatatcataagggattatttattttcattatcaaaaaaatataaggaaggtgagcaattggaaaactatactaagtataagctgaaaagtaatgatgagcttgcatcagtgcttgaaggcaaggacaatctgtttgtgattgcatgtaacaagtgtttcaaagaatttgaaactgttgacgaaccagattgcgatgagtttttaaaatttgctgcagagcaggggaaaaatgtcacaggcagtgcaaaattagacttcttatgcaataagatgcacacagaaaacaaattacaggatttgattccggagggaacagaaaatgtagttgttatttcctgtggtcttggtattcagaccgttgcagatttagcgggcaaaccggttattgctgcaagtaataccttaaattacagaggtcaccatggtatggcacttaccaagaagagctgtgacgcatgtgcacagtgttatctgaatgttacaggtggtgtctgtccgatcgtcgattgttccaagagtcttgttaatggacagtgcggtggagcaaaaaatggaaaatgtgaagtagacccgaataaagactgtgcatgggaaaaaatctaccagagactggcaaaacagggtcgtctggaagaatttttaaatcagccggtacaggttcgtgatttctcaaaagtaaatttcaaagtcattaatgattatgtaaaatcaatcagagatgaaagactcaatggatattatggtggtgttcatccgtcagaacgtaaagagttcagtgaacatattgcacttaagaaattcccggaaccaaaaacggttgtaatctctatgtcccagcaccttggagcaccggcaaatccaatcgttgaagtgggcgataccgtaaaggtaggtcagaagattggagaagcagcaggctttatcagtgctccggtacattccagcgtaagcggaaccgtagttgctgttgaacctcgtatgcatggcacaagaggcagtgaagtaatggctgttgttattgaatcggatggaaaaaatactctgcacgaatccgtacagccacatggtgatttagataatcttacaccggatgaaatcattgatatcattcgtgaagcaggtattgttggtatgggtggtgcaggtttcccgacttgcgtaaaattaaaaccggcaaaaccggttgataccattcttttaaatggatgcgaatgtgaaccgctcttaacagccgaccacagagtactccttgagtttgccgatgacattatttttggtttaaaagcaatccttaagacaacaggtgccgaaaaaggtatcatagttatcgaggataataaaccggatgccattgaattaatgcaggaaaaagttgccaatatcggaaatatggaagtgtttgttgcgagaacgaaatacccacagggtgcagaaaaaactctgattaaacgtgttatgggaagaaaagttccaagcggcggtcttccggcagatgttggtgttgtagtagataatatcagtacagtaaaagcaatctccgatgcaatccagacaggtatgccactcgttgaacgtgttgcaactgtaactggtgaaaagattaaaaatcctggcaactttatcatcaaaatcggtaccagcgtaagagaactgatcgattactgtggtggatttacagatgatgatgttctggttaagatgggtggtcctatgatgggattcccacagagtacattggatgtaccgatgatgaaaggttccaatggtattattgcaattgatacagatgagacaaaagaacagccatgtatcaaatgtggacgctgtgttgatgtttgtccgatggaactgtctccattgtattttgtaaaatatgccaaagaagagaactggcagggcatgaaagatatgaatgttatggattgtgtagaatgtagatgctgccagtatatctgttcttctaagattccgattattgacagtatcaaagccggaaaaaatgcgataagggggatgaagtaatatgttaattacccagttaaaagcaaaagaaacaattacatcattgacagccggaaaaaaagtttttatcatcaactgccatggatgtaaggaagttcgttttccggaaaaagaagctgttgaacttcagaaagaacttgccgctgaaggaaatgtaacaggtgttctcacaactgattatatttgcaatccggaaaatatggagttacgtctcaaaaaacatttaagtaaaattcaggaagcagacttagttttagtattttcttgcggtgttggtgtacagaccgtagcagaatatcttgaagataagatggtctgtgcagcttgcgatacatatccggtacctggtttccagggcgtgacaccgttagagtacaaatgtgaccagtgcggtgaatgttacctgaatctgacaggtggaatctgtccaatcacagcatgttccaagagccttgtaaatggccagtgtggcggttccaagaatggaaaatgtgaagtggacagtgagatggaatgtggatgggaacgcatttacagacgtttgaaagaaatcggacgccttgatgtattaaaatgcccgacacaggttcataacttcgcaacagacgatgaagtaaaatagtgaaaaaagaagcttaattaagctatgatattataatgattggagcaatgtacaatgaaaatgaaagaattattcgaccgtggtgaatttgtagtttctgctgaagtaggaccgccaaaagggattcatgtagatgagctgttagaagaagcaaaaacataccttcagggtgttcatgcagtaaacgtaactgataaccagtcttctgttatgcgtcttggttctcttgcaatgtgtaaagcattaaaagatgcaggcatgaatccgattttccagctggcatgccgtgacagaaaccgtattgcactggaatctgaccttctcagtgctgcaatgtttggtatcgaaaacatcctctgtctgactggtgaccatacaaaaatgggtgaccatccgcaggcaaaaccggtatttgacttagactctgtatcccttcttcacacagttggactcttagagtcaggtgtagaccttggtggaaatgaattagttggcgaacctccgaaattctcaaaaggtgcagttgtatctccatgcagcgattctgttgatgcacagcttgctaaaatggaaagaaaagtagctgcaggtgcagaatacttccagacacaggcaatctttgagccggaaaaattcatcaaatttatggaaaaagcaaaacagttcggaaaaccggtacaggttggtatcatcattccgaaatctgcgggaatggcaaaattcatgaacaataatgttgccggtattcatgttccggatgaaatgatcgaagaattaaaagcagataaagaaaagacaaaagctggtattacaggtgttgaaattgcagcacgtattatcaaagaatgtaaaccatactgtcagggtgtacatatcatggcacttggctgggaatctaaagttccggaactgctgaaacaggctgaaatctaaaaataataaatttaagaagaataataatagagggagcagcgcacaagttagtgcgtagctccctcttagtttaagcaagcagttctttcatcgcttctaataattcggtatttttttcagggctcatcagacagaaccggatataactgttatctaaaaacgggaaagtggaacagtcacgaatcatcaatccctttttgatgcagtggtcaaacatcatttcggaagtgacttcttcttttaaaatttttacaagaataaaattcgtacaggacggatagactttgacggtatccagtttggacaattcatttgtcatgcgttctcgttctgtggtaattaaagtctttgttttttcaatatattctttatcggaaaacatgatacagccggcaatttctgccagactattgatagtccagggattctttttggtgttaatatgttttaacaaatccggatttccggttacggcatagccaaggcgaagccccggagctgcaaaaaatttggaaattccgcgaagcacaatcagattggtataattgttagtcagcggaatggaggacatattcgctgcgtccggagcaaattcttcgtaagtttcatcgaccatgacaaacattccgtactggagtgcagtatccaaaatttttctcatttcttttttggtaatggcagaagcagtcggattgttcggattgcacagcacaagtaaatcaatcgaatcatttagctggtggcagaaatcatcgacgttcatctggaaatcattttcttcttttaatggataatataaggtatgtccgccctctaaggtgatttcacgctcatattccgaataagtcggtcctaaaatcagggctttttttggatgagtggattgaataaataaagaaatcaattcagtagatccgtttccaacaataatattttcaaactgcgcaccggtataatcacagatactttttctcagttttgtatagtcgcggtcgggataagaagtgatagcgtctacatgcctggaaagagtatcccttaaaagaggggaaattccaagtggatttacattggcagaaaaactggtaatatcctcttttttgattccgtaaatatcctctattttttctaaatcactgccatgaaaatggtctttatgtttcagcatatcgtagatgctcctttcttttttacgtgtcatgcaacttgtctgatgcagtctttcgagaggttgcgtctgttgcatttgtagtgtataattcacattatagccagaaaataaaaattgttcaatataaaataagcaacgggaaaaaaagagaaacaacggggtaaatacattgaagagaagaatggagcagttaataaacggaagatttgaatatgaagtgccaaaactcctgttttcacaaaacagcattgcggtaagtacaaagccggaagaaaatgtaaggggagagctggttattcgggcagaagataagagccgtatcaaaggacttgtatactcttctcaccgcagatttcttcttggaaaagagcgttttttaggacaaaatgtgacgattccttatggcgcagatgtgaatggattaaagccaggagattcctttgagggagaggtggtactgactacaaatgtaggagagtatcgtctgccatttcagatttcaatcgaaaaagaagaagtaaagacagctatgggtgcaatcgacaatttggatgcatttacacagcttgcaaaagaagatttcagggaggcatatcatttatttgtagatgcctctttccggacccttttaaaagattgtcaggaattgcttccctattattttgcaatgacgacaaaaccggttacactacagaatctggaagagtttttaattggaattggaaaaaaagagcgggttgccctgaaaatcgaatcggaaaatctggaagtttatgaagtaatggcttctttaaaagatactcttcggattcatagaagcacctggggacatttaaaagcagaaatctttgtagaaggggattttctggaagtagagaagaaaaaaatcagtgatgatgatttcatcggcagtgtttatgagatggaatatattatccgcagagaaaatcttggaaaagggaaaaatttcggacggattcgtatcaggacggtgtatgaagaactggtttatacggtgatggcgtcaaagtcaggagaaagacaattagaccttgagacttatgcaaagcataaaaaagtagaactgttgcgggactttctggatttcttacttggaaagacagaattttcgttctggaagggacagacggaagccgcattttcagaagcacaggagaatggatttttcacgactgagtacaaactggtacaaatttatctgttacactgcttaaatgagaaggaacaggcaggaaaactgcttggtcagttaaagtctgaaaaagaagtgatgaagaataaacgtctgtccggaatttgcgagtatttggaatatgtgctggatgacaataaagaagcatttgaaacttctgcaaaggaaatgcagtttttggagaaacagtacaatgagggcagcaggagtccatttttatatcttcaggcatgccgtcttgccgagaaagatggggcactgcttcgcagatttggtggatttacaagacaggttatgctgtttgcaaaacgtcatggaatcctttcagaagagatggcatttcgtgcaacagatttatcggaaaaccttcgagagtattcggaatctgtctatgagctgctggaatatatttatcagagatatccgtccgcccaggttgtgcgtgcaatttgccttttgattatgaaaggaaaagcgggagaagaacggtatttcaaatggtatgaacttgcagtgcagaaagatttgaaaatcacaagactctacgaatgttatatcgagacgatgagccggaattatcgtggaatgttgccgagaatgatccggatgtattttggatacaacaataccctgagtgataccaaaaaagcttttgtatacagcaatgttatccgcaataaaattcttgataaggtaacctatcaaagttatcgggcaacgatggaacagtttgcacaggataaattaaaagagggacgcatcaatgaagattttgcggtgatgtatcgtgaattttgtctgaacagtaaggatgaagtaatcaaacgggcacttggaaaagtattgtttgtacatcgtttgtactgtgatgatccgaaaattcgaaaagtgattgtgaaacactctgcgtttgaaaaagagcaggtttatacgtttaacaatcatgcagcatatctttctatctatacaccggatgcaggaattgtatttgaggacgactgccagagaagatatattcagaacgtggattataatcttcagccgttatttgagcgggaagagctggcgagagaacttgcaaaggaagaacatcagagcgcaggactgcttttatatacgtgtggagaacttgcacatgaaaatcagattacactgacgaatcttcacagttttgagcttgcagccgaggaagaaagcttttcaaaagaatacagacagcagattcgcaaacgtttattgttgttttatcaggaatacatgggagaagaaaatttgaaggcttctctggaaaaaattgattttcagagttttgcaaaaatcaataagagccttttgattacaattctgattaaacagaaaatgtatgtgggtgcttatgatttaatctgtgaatatggatatgaagaaatcaatttcgtggatttactgcacttgtgcacctgtatgattcaaaatctggattttgaatatgaagaggaattagtgcttctggcgcatgacatttttgaacagggaatttatgatgaagttatcttgaagtatctggtaaaatactttaaaggtccggttgataaaatgatagaaatctggcaaagagcaatgggattttctttggatgcttatgagctggaagaagatatcttgattttcagtatgtttggacgaatctggacacctcagggctcggcggtattaaaagattatgtcagacagcgtggaaaagaagtggtaattcttgcttatgttacctttgaatcctttgaatttctgcttgccggcaaagaatcagaccgttttgtgttccgttcgattgaacaaatccgcaaacgtgaatgggaacatgactcgatttgcgatgtggcattgttaaaatcttatgagctggaacaggactgggatgaaaagcgcatgacaaatgcagaagccattttggaagaatgtgaaaagaagggattaaaatttgctttttatcagaatcttccacgaacgcttttacagaagagccaggaagaagataaagtatttgtagaatgttttgccggaaatgatgcaaaagttacgctgtattaccggattcgtgagaatagtcaggaagaaactccatataaagaagaaatgttggcaaaccgctatcatggaatttttaacaaagaatttctcttattctgtcaggaaaccttggagtattatttcgtaatcgaaaaagagaaaaaagagtatacaaccgaaacagaagaattaaccgtatccggtgaaaagaaaaaagaaacaacaaaatatcagatgataaatcagatgttgtcagcaaaacagcatggaaaagaagaggaattaaaagatgtgcttgaaacatacaggcaaagagaagcctggattgcatcacttttccgattgatggaatagcagagggagacgaggaatgaacgagacaagaaatatcattgcaagtctggaatttggagaaaaagaatctcagatttgttattatgacagaaaagaaaaaaatccggtttctcttgcggtaaagaccggaacgacggaatatacctttccgacaagattgtccaaacgtcccaaaacaaatatctggcattttggagcggaatccgaatatttttcgaaatatgagggagagatactggtagaggatgtactgaatctctgcatgaaaggagagccggttgagattgacggagaagtccatgaggtagaagaactgcttgaagtattcttaaagggctgtctttctatgcttggagtgggagaaccgcaaagacagattaaaattttaatgattacaacgccaaatctgaatcgggtatttatccgtaaactgcagaaggtgtgcagacatttgaattttgcaaatggtcaggtactgatacaggattataatgagagtttttattattatgcaatgcgtacccgccatgataatgcaaaccgaagtacaggcttattctgctttgataaaaacagagtgcattttcgaaaactctggattgatacgacaacaaaaccgatgattgcaagagttgaagtgggaaaatccgaattgctttcggaaaatccgaaaaaacgggataagagattcgctgaaatgattgaaaaatgctgtggagaggaaagttattcaaatctgtatctgattggcgaaggatttgataaggaatgggcagtagattctcttaccgccctttgtaaaaatcagagaagagtttattacggaaataacctgtatgtacggggagcttgctttgccgcactggaaaaaagtgaggataagactcttggaaattacctgtatgtgggagaagctttagtaaaaaatcatattacaatgaatatgaacattcagggaaaagaccagatttataccgtaacagaaggtggaaaaaactggtacgaaacggaacatacttttgaactgattttagatgaaaaagaagatttggaatttaccttacagcctatggatggagaaaagccttttgtgcacacaatgaagttaaaaggacttccgaaacgtccgaagaaagcgaccagattacggatacaggcagtttatgaatcagcagattgctgtgtggtatttgtggaggatttgggatttggagaacttttcccatcaagcggtttaaaatggaccgaaaaaataagatggcaggaggcagaacatgagtgattatattttatgtcaggtaaaaagggcttcgctgccgttttatgtggaaaacatcagtaaaaatatttatagcatagaagaactctgttattatttttataaaaatatttatctgattgatgaaagtattatcaatgaacggctctgcaactggctgaaagatgagttgggactgtcaaaattatatgaaaagctgtaccggattttggaaaaagaagagggaacgagtgcatttattctggcaattttccgtgagattcattatctttcccatgaagaatttaagaaattaaatgaaacccttgaaattttagaaaagcagcttccggcagtgcgaatcaagaaaaaaggcgattatcttgtcagcaaccggatgtatgtcaatgcaatccgaatgtatgaaaatgctctggtatccgcaaaaagagaggaaaatcttggacttcagtttgaaggtgaaatttataacaacatggcttatgcgtatctggaactgtttcagatggaagaggcagcaaaatattttaagaaagcttatgaaaaattgccgactcagcagattcgcagacagtatttctatacctgccgtatgtttatggatgagggaaaatggagagaagaatgtgaaagcatgggagcggatgagaaagagcgaaaagaacttgtctatgaaatgagtcaggtcaaaccagagcagatggcgtggaatacagaagaaattgatgagatgctttctgattttaagaaagaatatcatagaagtacagggttttagcttgtgttttcttgctacgtgagctataatccaaaaagtaagaatacttgtaaaaacgaaaaaaggagattagaaaatgagtacagacagatatcagagtccattatctgaacgttatgcaagcaaggagatgcagtatattttctcaccggatatgaaattccgtacctggagaaaattatggattgcacttgcagagacagaaaaagaactgggattaaatatcacacaggaacagattgatgagctgaaagcacatgccgatgatattaattatgatgttgcaaaggctcgtgaaaaagaagtacgtcatgatgttatgtctcatgtttatgcatatggtgtgcagtgtccaaaagcaaaaggaatcattcatcttggagcaacatcctgttacgtaggagacaacacagatattattgtaatgacagaagcgctcaaactggtgaaaaagaaactggtgaacgtaattgcagaacttgcaaaatttgcagatgccaacaaagcattgccaactctggcatttactcattttcagccggcacagccaacaaccgttggtaagagagcaactttatggatgcaggaatttttaatggatttagaagacttagagtatgttcttagcaccatgaaactccttggttcaaaaggtacaaccggtacacaggcaagtttccttgaactgtttgacggagaccaggagaccatcgataagattgacccgatgattgcgaagaaaatgggatttgaaaaatgttatccggtatccggacagacttattccagaaaagtagatacaagagtattaaatatcctggcaggaatcgcagcaagtgcacataagttctcaaatgacattcgtctgcttcagcatttaaaagaagtagaagaaccatttgaaaagagccagattggttcctcggcaatggcgtataagagaaatccgatgagaagtgagagaattgcttctttatcccgtttcgttatggtcgatgcgatgaatccggcaattacatccgctacacagtggtttgagagaaccttagatgactctgcaaacaaacgtctttctgttccggaaggcttccttgcaattgatggaatccttgatttatgcttaaacgtagtagacggactggttgtatatccaaaagtaattgaaaaacgtttaagaagcgagcttccgtttatggcaacagaaaatattatgatggatgcggtaaaagcaggcggagaccgtcaggaattacatgaaagaatccgtgaactttccatggaagcaggaaagaatgttaaagtagaaggaaaagaaaataatctgcttgaactgattgctgctgaaccagcatttaacatgacattagaggatttacagaaaacaatggagccatccaaatataccggaagagccgaagtacaggttaatgcatttttgaaaaatgtagtacagccggttcttgatgacaacaaagaaattcttggtatgacagcagaaattaatgtttaaattaatattttgataagaaagacaagaggggtcttataggtaacttttacttataagacgccccttttttggaaaaaaacactaaaaataaaaaaaacaatgctttttttaaaatagaactttatttctcaaaagaaatgtagtatgatacatgagtacaaataagcacttttaggaggaatgcaaaatggtaaaagcagtagtaggggctaactggggagatgaagggaaaggtaaaattaccgatatgctggctcaggaatccgatattatcgtaagattccagggtggtgccaatgctggccatacaattgtaaacaattacggaaagtttgcacttcatactcttccgtcaggtgtgttttatgaccacaccaccagcgtcatcggtaacggtgtagcgcttaacatcccagtactgtttaaagagattcagtcaattgtggaaaagggtgttccgatgccgaagattaaagtatctgaccgtgcacagatggtaatgtcctatcacatcaaatttgatgagtatgaggaagaacgtctggcaggaaaatcttttggttctacaaagtcaggaatcgcgccgttttattcagataaatatgcaaaaataggttttcaggtaagtgagctttttgaagatgaagcagtactcagggaaaaagtagaacgtgtctgtgtaacaaaaaacgtacttcttgagaatctgtatcataaaccggctttaaaccctgatgatatcatggaagaattaaaacagtacaaagaaatgatagcaccttatgtgtgtgatgtttctttatacctttggaattcattaaaagaaggaaaagaaattcttttagagggacagttaggttcattaaaagacccagaccatggaatttatccgatggttacttcctcttctacactcgcagcttacggtgcagtaggagcaggtatcccgccttatgaaatcaaaaaaattattacagtctgcaaagcatattccagtgcagtaggagcaggcgcatttgtatctgaaatcttcggagatgaggcagatgaattaagaagacgcggcggtgatggcggagaatttggtgctacaacaggacgtccaagacgtatgggatggtttgactgtgtagcttctaaatacggatgccgtatgcagggaacaacagacgtagcatttacagttttagatgtacttggataccttgatgagattccggtttgcgtagcttacgatattgatggagaaatcacaacagaattcccgacaaccgcattacttgaaaaagcaaaaccggtaatcgaaacattaccaggctggaaatgcgatattcgtggaattaaaaactacgaagaccttccggaaaattgtagaaaatacattgaatttgtggaagaaaagattggattcccgattacaatggtttctaacggaccgagcagagatgatattatttacagaaataaataagatttaattaaaaacaggacagaggacccctaagtcgttacgaaagaatgactcaggggtttttgtctggaaaagtaaaaacaaagtagagtataggagatttaagtttatgaaatatgatgtaattattattggtgcaggtccgggtgggattttctctgcttatgaactgcttgagcagaataaagacttaaaaattgcagtatttgaagcaggtgcaccgcttgaaaaacgccgctgtccgattgatggtgataaagtaaaaacctgtattaaatgtaaaacgtgtgcaattatgagtggatttggaggagcaggtgcattttctgatggaaaatataacatcacaaatgatttcggtggtactctctacgaacacattggaaagaaaaaatcactggaattaatgcattacgtggatgatttgaatgtaaaattcggtggcggagaaacaaagatgtattctactgcaggaacaaaattcaaaaaactttgtctgcaaaataaattaaacctgttagatgcatcggtacgtcacttaggaacagatatcaactatatcgtactggagaacatttatcaggaattaaaagacaaagtagaattccgtttcttctatccggtcagccgtctggaaatgttagaagatggatatcgtgtgttccacgaagaagaatatgatgactgtgataaatgtatcgtttctgttggacgaagcggaagtaagtggatggaatctgtctgtaaagaccttgagattccgacaaaatcaaatcgtgtagacttaggtgtccgtgtagaacttccggcagttatcttctctcatctgactgacgaactttacgagagcaagatcgtataccgtacagaaaaatttgaggataatgtgcgtaccttctgtatgaatccgtacggaatcgttgtaaatgaaaataccaacggaatcgttaccgcaaatggtcacagctatgaagaccctgaaaaacagactgaaaataccaactttgcccttttagtatccaaacatttttctgagccgttcaaagacagtaatggatatggcgaaagtatcgcaagactctccaacatgcttggaggcggtgttatcgtacagcgttttggagacttagtaagaggacgaagaagtaccgtgacacgtgtggaagaaggactggtacgcccgactcttgcagcaacacctggagatttgagccttgtgcttccaaaacgtatcttagatggtattatcgaaatgatttatgcattagataagattgcgccaggtactgcaaatgatgatactctgctttacggtgtagaagtaaaattctataacatggaagtcgatattgatgaaaatctggaaaccaaatataaaggtctgtatgtgattggagatggtagtggtgtcactcattctctttcccatgcatccgcaagtggtatctatgttgcaagacatattacagaagaatgaaataaaaatcaggtttcaacaaatatagcaaggattctcccacctctataggtggtgagaaaaattgcaaacaggaaggttaacggcagtggtgggcggagagaaatcggtatcctccattgacatgaggtaaaccacagtcagcgttttgctgacatgtcagactctgtgaaattaccgactgtggattgaaacaagaatatcaagaatactttcttcaaaaacaaattgattttctttacggatttttttataggcagatggcggaagtggagactccgccctgcctatttctattgtcagacttggaatattctgctttaaaagtgcccagtctttatagcctgccgggtcaagttcctcataattgtcatcgggagtatagccggtaatgtcagaaattcttttggcgaaggactgtgttttttttgccagttctccacgctgtccaaatgaccagtaaatcacagcaccggaagagtgataactgatcgtgcggtcaaatttttcttttaacgttaattgaatcaaagtatctgcttctaaggtacatccggctgacggacctttataatgttcacttgccggtttttggactccatcatagtaactttcccagagcgcatcaaagtttcggtttacatcaatgccttctgcattggatttccagtatttaaagtactgtttccatggcatccttgccccttctctgcgtgcaatttcccatactctccttcggttttcctctttgtttagagcatcgggccccatttggctgatagtaacaccatcgggattaaccatgggaaggagaaagagcgaacaggtatcaaaaaaagtctgatacgaatatccacgataagtctgtttttctaaaatggctcttgcaaatgaggcagtcaaatccatgagaagctggcaggtcatatattctcttccgtgaatccccgcaaaaattagaattttgtgtctggcatcgggctttccgattcgtgcctgaaaaatttcccgaccgtcgattgtacgtgcaagagtggtgatttgtacaattttctcaaaaattcttgaataaatatgtaaatcattttttaagtcttgataagaatagccggaaaattgtagaatctgtcgattttctctgacatttcgagcattaatgtccattgacgtaaactcctgaactctttataattaaagatattcaaaaaagggaggtttcagacgtgaagaagctaaaacaattgtttgctcttttagtcgtcatactgcttcttggtttatatgcacttacccttgtatttgctctgatgaaaagccctgcggcacaggatttacttctggcatctttgtacgcaaccgtaattcttccggttcttatctatgccattttgctcgtctataaatggagaaaaccggatgataaaataccaaagattgacgaaaaacatgccaaagtaaataccattatttttgatttgggaaaggttcttgttgattatgactggcaggattatttaaaatccatggcattcgatgatgatgcgattgaggcagttggagatgcgatgtttgccagcgatgactgggtagaagcagatcgtggagtacgcacagaagaagaaattttacagtcttttattgataacgacccggaatatgaaaagcagattcgtgatgcgtttgatgatatgggctttacgattcatgcattttcgtatacaaaaacctggctgaaatacctgaaacgacgaggatataaactttattatctctcgaatttttcaaaacctctctttgaacggtgcacgcaggagatggaatttttaaatctgatggatggcggttatatgtcatgggaagtgcagatgataaaaccggacgcacagttttatcagaaactgttgaaagattttaagattgagccatctaaggcagtatttttggatgacgtgatggaaaatattgcagaagcaagagcacaggggttaaatgcagttcattttacaaataagaaagaagcaattcgtgccttgaaagacgactttggggtagaataacaaaaaagcaatccgaaaactcgggttgcttttttgaatgctatatatgctgtgtttcatttatcgaatggaaaatgcggaagccggagagtaagaaccgccttgctgtctgtcatttgagtttccgtttccgtttgtctggctgttgccgtcagaagaagtatcggatttgcttcctaaagagatggaaacagttttttctttgtagctgtcactgtccggtacttgaagagttaactcaaccgtttcaccggctttataatattgcagcaaatcctgaaggctttcgatatcagtgacggattttccatcgaattttgtgatgacagagccggaagtaatgccggctttttcagctgcgctgccagaagttacttcagatacatagataccttccggaagattatatttctcctgaacatcactggttacattgattcctttgataccgattgttccctgtttgtcagagtctactttggttctggttgtctggttcatcagattatcaatgatatcagaaactctggaaatcgggattgcatagcccataccttctacttctgtggaagcaagtttcgcagagttgataccgatgacttcaccattcatatttaaaagcgcaccaccgctgttacctggattaatagcggcatctgtctgaatataagttgcagaactgctgtcatcagaagaagagttgctgtcctgtgtatcagaagaattattgcttaaagcacgatttacggcacttacaataccggttgtaacggactgaccatatcctaaagcattaccgatggcaacaacctgttcgccgacttttaaagagtcagaatcaccgatggaagcaacagcaatctgagacattgtatcatcggaaatgctgtcaagcggaactgcgataactgcaaggtcattttctgcgtctgtaccttttacgtttgcctcatataccttattgtcgatgaaacaaacggaaagagtatcggcaccttctacaacgtgattatttgttaccattaaaagttctgtatcatttttgccgataataataccagaaccctgactttcggtttcctgagtctgtgtctgaccttggcctctaaatccgaactgactgaagtaatcctggacttcctgaacagatttatttgtgattgctacgatagatggcattgcagatgttgtgatatcagagacatctaaactgcctttattagagctgtcggaagtagtggttgtctttaacagactagcacttgaactattacttttagaagtctggcttgaactgtttgttgtttttgaaacaggtgaaaagtaatttacagcctggaaagaaccggcagcgacagaaccaaataaaacagcacttaaagtgatagcaccgattttctttgcaagttttttagaatttttaggattctttttattgttattatgactgccggatggtgtcagtggctgataagtattggtttcattttccatttcattattattttctgtatgattaaaatcgtaattgtttaacatcatcaattcctccttgttgttccctttgatgcttctaagaatacaggaagagtgtgacgaaaatgtcgagattctgtgatgaaaataaggtaaaagtgtgtaaatttggtgaacacgaaagactggacaatagagaaaatgggatttacattctgaaatccatgttttggtaaaagaaagcctctaaaacttgacaaaaaactacaaatagtggtactgttattgcaaccgcagtaacagcgggatgcaacgaaataaaagaatataataatattgaggtgcgaaaaaatgcaggaattgaaaccaatcaaagaaggtaaagtacgtgagatttatgacaacggtgatagtctgatcatggtagcaaccgacagaatcagttgttttgatgtgattttaaaaaatgaagttacaaaaaaaggaaccgttctgacacagatgtccaaattttggtttgacttaacagaggacattcttccaaatcatatgatttctgtagatgtaaaagacatgccggaatttttccagcaggacagatttgatggaaatagtatgatgtgccgtaaattggaaatgcttcctattgaatgtattgtacgtggttacattacaggaagtggatgggcaagctatcaggaaacaggtaaagtatgcggaattgaacttccggaaggcttaagagaatccgacaaattaccggaaccaatctatacaccatctacaaaagctgagattggagaccatgatgaaaatatttcttatgaagaaagtattgctcatctggaaaaatatttcccgggaaaaggcgaagaatacgctcagaaacttcgtgattacaccattgcactgtacaaaaaatgtgccgaatacgcactgagcaaaggtattattattgcagatacaaaatttgaattcggactcgatgaaaatggaaacattgtaatcggagacgaaatgctgacaccagacagttcacgtttctggccggcagaaggctatgaaccgggacatggacagccgtcttttgataaacagttcgcacgtgactggttaagagcaaatccggataataactggacacttccacaggatatcgtggataaaacaattgaaaaatatcttcagggatatgagatgctgacaggtaaaaaattagtttaaccaaatcaagtaagtcccctgcttcaattgcgaaaagcaataagcagggatggggacttgcttgtatcaggagggggcaagccccttctgataagctgcgtagcagctatttggttatgagcaagtagcgaagcgaattgcgaatatccacttaacggttagcttaatcaatgcaaaagggcaggttctttgtgaacctgcttttttttgtacaaaattataaaaaatatcccccggatagggttctggcatagtagcgaagtagtgtaaaaacaagaaaaaattaaaggaaaattatatccgcgcagggggcttacgaagacttgtaaagttaagtataatgaggaaaacacagaaaccacaggaggaacgtatgaaaaagaaagtagtaagtattttatgtctgacgactatgctcatggctgtttttacggggtgcggagctgaccagagtgaagagacaaagcagacagatgaagttaaagagacaaaacaaacagacgatggagtgcgggcgtatgttggaggaaccatttttgaaagtagtcttgacccaataaagggtgcgatgagttatggatatccttttatcaatgaggcattgctggaagtaaatccagattcggaatatgttggagatttggcaacagattggaaagtaagtgatgatgcactgacttatacatttaatttaaaagaaaatgtaaaatttagtgacggaagtgattttgatgctgaagatgtagtatttacatataagacggtgaaagaaaatcaggcaaataatgaaaacgttgatttaactcgtcttgataaagtgacagccttagataatcacacggttgaatttaaattaagtgaagcatattctccgtttttggataccattgcaatgttacagattgttccttctgatgcttatgacagcgaattgtttgatacacagccaattggaacaggtgcttataaggtgtctcaatacgatgcaaatcagcagattattttagaagctaatgatcagtattatggagatgcgccggaaattaagaaagtaacactggttgcaatggaacaggaggcagctttttcagcagcaaaatccggagagctggatatagtaatggtgggtgcgaactattcaaaagaaaaagtagatggtatgactgccactaattttgaaacaatggatgtaagaaatatttcgcttccggttaatccgacgatgacagcaaaagattcagaaggaaatgaagtggttgttggcaacgatgttacttctgataaagcagtccgtgaagcattatctatcggtatcaatcgtcaggagattatagacaatgcatttaacggtgttggaaaaccagctgtgaattttacggataatttagtatgggcttctatagaaacttatgaagatggaagagtagatgaagcaatcaaattattggaagatgccggctgggaagattctgataatgatggaatcagagaaaaaggtgatttaaagtgtacatttgatgtgtattctcccggtggagatcaggatagatacaatttagcagttgcattggctgaaaatgcaaaaaatttgggaattgatattcaggtaaagactgctacctgggatgaagttaccacacttcagaatacagcgggcattgtatgggggtggggtcagtattcacctactgtattatattcgctgtttaaatcagatttatttttaacaggtgggtatgacaatgtagttggatataaaaatgatgttgtagaccagaaaattgatgaggctcttacagcgaacaatcaggaagatgcaattgcagcatggaaagaagttcagaaaattgcagatgcagattatccggaactgtacttagtaaatattgaacattgcttttttatcaatgataacttagacatatcaatggatacccagattccgcatccacacggacatggaagtccgattgtatgtaatatgaaagattggaagtataagtaaaaaataaagatacggtttttaggtgacctgtctgagataggtcacctattttgggagaaagggataaatgaaaagcgtaaaaaaaattttatcggaagcgattaggatgcttttgttattgatagcagtaagtttggtggcatttattcttattacaaaagcaccaattgaccctcttgtatcttacatagggacaaattctacgttgtcaaatgaagcaaaggaagaaatatcggaatattggggattgaacgacccattgccggaacgatttgttacgtgggcaaatcatgcattacatggagattttggagagtctatcacgtataaaaagccggtaatacagattattaaaacaaggtttttatattcaattgtattgatgctactggcgtggtttttttctggaattttaggatttgttcttggaatattatgtggaatacatcaaggtggtatttttgacaggtttatgaaactattctgtttgattacaaagtctgcgccaactttttggttgggcttgttaattttatcgttgtttgcagttcaattaggatggtttccaatggggatggctgtgccagcgggtaaattagccagtgaggtcacaatctgggatagaatttatcacttgattttaccggtgcttacgttaacgattgtaagtatgagtgatgtaatcctgtacacaaggcaaaaaattgtagagattatgaatagtgattttattttatatgcgaaagcgcgaggagaatctcaaaaacaattaataacaagacacattttgagaaatgttattttaccggctgttactgttcagtttgcatcatttagtgaactttttggaggaatggcattggcagagaatgtattttcctatccaggaataggaacggcaactacggcagcagctttaaatgcagatgttcctttgttactggggattgcattatgcagtgcaatgtttgtatttgcaggaaatttaatggcaaatattttatatggcgtattcgacccgcgaatcagagagggggaagagtatgtctgataaaaaaattgtatggaatagaaagaccaaaattgttgtattaatggtaatcgcagttgtttacctggcagggatttttatatggggaatatttatgaatcctgaaaaatatgcagtaaactatgcaaataaattcttgagtccaagtttaaaacatccttttggaacagattttgttggaagagatatgttttatcgatgtgttaaaggattgtcaaatagtattgtgataggaattcttgcttcaattgttagctcaatagttgcgttaatatttggaatagctgctgctgtttttggaaaatgggtagataaggtggttaattggggagtggatttgtgtatggggcttcctcatttggtactgttaatgttgatttcctttatgttgggaaaaggagtaaaaggagtaacaattgcagttgcattaacacattggccgtcactgactcgaattgtgaggtctgaagttatgcaaattcgttcttctcagtatgttcaagctgcttataaaatgggaatttcaaaatggaaagtggcagttactcatattgttccacatgtgttgccatcttatttgattggtttagtgttattgtttcctcatgcgattatgcatgaagcatctattacattcttaggatttggacttccggcagagatgcctgcaattggtgtcattttatctgaagcaatgaaacatttagctacaggaaaatggtggctggctttatttccaggtctattattgctaattgcagttgttttatttgatgttatgggagataatctgaaaaaattatggaatcctggaagtggtaacgaatagaggtaaaaatggataatagaaaaacagttttagaagtaaatgatttggttgtttcttttagcatgtataaaaaaggatttagaaaagaaaatctggaagtaattcattccttgtctatagatgtaaaagaaaaagaaattgtggctattgtaggttcaagtggttcaggaaaaagtcttttagcatcggcgatattagggttattgcctggcaatgcaagcacaagtggaagtgtctgctatatggggaaacagttggatgataaattaagaaaacagtatcttggtagagagattgcatatattccacagtcggtagaccatttggaccccgttatgaaagttggaccacaggtagtaggggtatattctacagaagaaaaacaacgcaaaatgtttcaaaaatatcagttagataaaagtgtagaagaaatgtatccgtttcaattatccggagggatggccaggcgtgtactgatttcagcggcggtgttggaaactcctaaattaattgttgcagatgagccgacaccaggacttagtgttgatatggctatggatacattaaaacattttagaaaaatagcaaatacaggtacgggaattctactaattactcatgatattgatttggcatttgaggttgcagatcgaattgcagtattttacgctggtacagttgtagaaatttcaccaacggaagattttaaaaagggaaaagaatacttacgacatccctacagcaaggcatttctgagagcattgccacaaaatgaattccagccgattcccggaatacagccttatgctggaaatttgccagaaggttgtttatttgcaaatcgttgtcccgatgtatctgaaaaatgtacgggacaaataccaatgagggagttgcgagggggaaaggtcaggtgtgtaaatgcaacttaaattagaacatattgattttagatatacagataaatctccttggattttaaaagatgtttctttgacaatagaagcaggagaacgtgttggaattgtaggaccatcaggttatggaaaaagcacgttatctaaaattattgcagggtatatgaatccgacttccggaagcgtgatgattgacgaaaaaccgctgcctaaaaagggaatgtgtcctgtacaaatgatatatcaacatccggaatatgcagttaatccaagatggaaaatgaaaaaaatcctgaatgaatgttggactcctggagaagaagtattagctcggatgggaattgaaaaagattggctgaaccgttggccgtcagaattatcaggtggagaactgcagcgtttttgtattgcacgaatattaagtccggatgtgaaattccttctatgcgatgagattactacgatgctggatgtgatcacacaagctcagatatggcaggtgcttttggatactgcgaaaaagaacggttatggaatgttaattattacccataacatggcgctggctgaaaaagtatgtacaaggatagtagaccttagagatattaatcatatcaaacagattgacgtatgataattaatcctgaattattcatggaacaaccatgaataattcaggattagatttatcgaaaaattcagctatagatttccgaccagtttatctttccagataccaagacattctcgcaccagataatttagctgtaaaaatttgttactttttgccggaacaccttctatctgtcggcatcccatcttttttccaatcgaagttcctcgaaatacgtgaaagccgttggttacgattccaattcgtagctcttctggctttttatttaattctttttctaaaagtgcaagtgaatattttaggttttcatttgtattagtagaacggtcttcttttatcagacgtctcgtatcgattccttgtgaaaccagatattcatacattgcttctgcctcggaaatctcttctcctgaaccttttccaccggagacaaccgctattgtttctggattttcattgagatattcttttgcccgcttcaagcgaagcttcaatgaattacttaatttcgttccattgacctgtgcccctaatacaatcagcgtgtccagatttttagatggtttctgagtcattcccgaaaaaatcagaccttctgttatcaaaaatgcaatgactatcaaaatcgccagagtaaggcatactgtttttacaggttttggaaatatacttaaaatattccagtgatgcgttgtttctaatcgtaacaaaattgctattgcataacacacaagccctgctgctgcccagatacacggaaataaggaagaaaatcctgcatacaatacaattccgataaaataaagaatactaaaacttcctaatagaataaataatattctcataaataaaatcctttcactttcgttagtagttttttctgacagaaaaagaagacggaaaaattccgccttctacttttttataattatttgttttttccacagcagtgtttgtattttttaccacttccacatggacacggatcgttacgtccgattttcggtccttttacaactgtaccggattttttctgttctacatataattcttttttcttttcttctgtaaagatttcatcccactgaggaagattgtacagccagtctgcttttgcgtctaccatgtttttgtagagcatttctgtatcaaatccgagatttactacagtgtcttctttcatttcttcgattggattctgtacttttaagctgtcattgattccatcaaggaaaccaaccattgtcataacgtctacatcaaatttttcagcaagctcttttacagttcctctttctacatttgtcgggtctgcaagaagtttttcataaattcctttttcgattaagaaatagtttgtccagaatttctgaagctgtgccctgtctgcttcctgagaatatgcaatctctctccattcctgtaataatgccatgtattttaccaccttttacttaatattcatattttgggcgcaaagcacctatacgtaacagtatatacgatatgcatagatttttcaatgttttttatggattccaggcagattatgcattgcaagcaaaaaaaaacgggtctataatgagaagcgcaaatgaataaatgaaaaggaagaaagagaaatgaatgattcaaaacttacaatccgtggagaacttactcttattgtgattgtcattatcaatagcctcggcgtcgttttgatgcttcactctggctcaggcatatcagccatttcaagtgtgccttatgctttttcggaagtatttccaaaactcactcttggaacctggacttacctttttcaaagtctgcttatcttaactttaatggtacttcggaaaaaatttattccggaatacttatttagttttgttatcggatttttctttggaaaaatggtagatatccatcaggcatgggtcagccagcttccatacacgattccattgcgtgtagtatattttgttttaagttatctcatcatctgctttggaatcgcactttcaaaccgctgtaaaatgccgattattccgacagacctgttcccaagagaacttgcagatatcttaaaacgtgagtattccaaaatcaaagttccttttgatgttacctgcctgtttattaccggatttatgactttcttatgtcttggacatattatgggattgggtgttggaacagttcttgccgcatttactatgggaaaagtaattggaattattggaaaagaaatggataaaaaggttcaatttatttctattatgaagtcttaggtaaaagaaaccaatttttctttcatcctagtattttttaaattatttgtcaatcccattgtatattttaacagaaactgctcatactataagtagtccacggagggaaggcacaaatacgtgacgctcttcttggaagaacaaaagaaaaagtagaaatacttatcctcccctttgaaaagcccctgcacttagaagaagcccaactaagtacaggggttttgttaagtcgtttgattttctgttctgtaaaagataaaaaattaatgcataaaaaatttttttctacacatactgtttttggtaaacgtactctcagggtatgaaaattaaggaggaaataattatgccgttattaaattgtacagcaagaacctgtgtctacaacaaagaggaatactgctctaaaggagatatcgtagtagatggaagcaatgcaaaagttgcagacgaaacctgctgcagcagttttgtggaacgaagcggaagtgcgatgaacagcattggcggagaatgtggatgcaaaacaattgacgtaaactgcaaagcctgccagtgtacatttaacaatcaggagaaatgcagtgcagataaaattacaattacaggtgcaagtgcctgtcattgtgatgaaacaaaatgcggaagctttgagctgaattaagttacagaaaaaagaatcccgggaaacgggattctttttacataaatcccttgacattgcagtttatttatgatatcgtaatacagtctgaagaaaaagaaagcagagtaattgctctcaccttagcacgagtaagtgactatggttcatatttgaaataattgatgcgcttttgcgttttctttatgggaatatgttgtggagagcttatgctgtccactttttatttatttcataggaaattctttcttatttttttcagaatgttatgaggtaggtggctgacaaaaaagtcagatgagtgttttatcaatattatggaggtgcacaacaattagcgaattaatgattaatgaacaaatcagagacagagaggtccgtctcattggcgcaaatggagaacagcttggtattatgtctgccagagatgcgcagaaacatgctcaggaagcaggattagacctggtaaaggttgctcctacagcaaaaccgccagtttgtaaaattattgattatggtaagtataagtacgaattagcgagaaaagaaaaggaagctaaaaagaaacagaaaaccatcgaggttaaggaagtgcgtttgtctccaaatattgaagaaaacgatttaaacaccaaggtcaacaatgccagaaaattccttaccaaaggaaataaagtaaaagtaacacttcgtttcagaggtagagagatggcacatatgcagagcagtaaacacatcttagatgagtttgcacagtccttatccgatattgcggttgttgaaaaagcaccgaaggtagagggacgcagcatgaccatgtttttgacagaaaaacgctagacgttcattaaaagagttttaaggaggatacaatcatgccaaaaatgaaaacaacaaaagcagctgcaaagcgcttcaaaaaaacaggtacaggattattaaaaagaaataaagcttataagagccatatcttaacaaagaaatctcagaagagaaagagaaacctgagaaaagcagctattacagatgctactaatgtaaagaacatgaagaagattttaccgtacatctaattcgatattcgttttaaaacaggaggaaattaagaaatggcaagaatcaaaggcggattaaacgcaaagaaaaaacacaatagagtattaaaaatggcaaaaggatacagaggtgctcgttctaaacagtacagagttgcaaaacagtctgtaatgagagctctgacaagtgcttatgccggaagaaaacagaaaaaacgtcagttcagacagttatggatcgctcgtatcaacgcagcagcaagaatgaatggtctgtcctacagcaaatttatgtatggattaaaactggctaatgttgacttaaacagaaaagttttagctgacatggctatcaacgatgcagaaggatttgctacattagcagaacttgcaaaatctaaacttgcttaattaaaattagaagtgagaaatcaggcaggagatgaaatttttgaatttcatttcctgtctttttttaaatactattgacggaaatataaaaaagaagtaaaatgttcgagaagaatgtataaatttagaaacaggcagtgaatcctgtaggtaggattcttttttttcgccttttgtgtacgcgcagcacgtgcaaatgtgtttgagatttatacttcttcaggttttaagtcaagaggaggaaaaaaagatgaaaacctacaagaaaatcatggatgtgcttgccggtatcgaaaaattgattttagttgtatcaacgattttgattctggttctcacagttggaaatgtattttcaagaaaagtcatccaccgttcctggtcttttacagaagaactggtggtagcagttttcgttctgattaccttactggcagcagctcttgcatgccgagagggagagcttgtcagtttaaatctggtaacagaacgactgccgaaaaaaacaaaaaaaccaattgcaattttagtgactgtattatctgtaatttttacaatgatactgttctattacggaatggataaggtactgacacagcttgcaaatggaaaacgtacattcgtattaaattggccggaatggattttctggtcctttgtaccgattggtgcaggctgcatgattcttcattttattgaatactgcattgatttttgtacagactttaaatttgcaaagagaaaggaggaggcataagtgattagtgcggttttattcttatcattttttgtattcttaatcttaaatgtgccgattgcgatttgccttggactttcttccgtatgtgcaatcttatattcgggaacttctttaacaatagtggcaacaaatatgtattccggaatcagtaaattcttattgcttgccattccatttttcgtattatccggaaatatcatggcaaaagccggaatttcaaaacgtctgattaaatttgtaaatacctgtgtaggacacagaagaggtggtattgcgattgtatgtgttatcgtagcctgcttctttggcgcaatttcaggttccggtccggcaaccgtagctgcgcttggtgcagtcttaattccggcaatggtagaagaaggaggattttctgctccattctcaacggcaatgatggcaacttcaagttctatcgcaattgtcattccgccaagtattgcattcgtagtttatgcctctattacaggtgtatccattgcggatatgtttgcaggcggaattattccgggtgtcttaatgggtctggcactgattgttgtaattatgattgaagtgcgtaaaaaaggaatccagccgacaaccaaaaaagcaagttggggagagcgtggaaaagcgtttgctgatgcattctggggattcttaatgccaattattattcttggcggaatctatggaggaatctttactccgacagaagcagcagcggtatccgtagtttatggtctgtttgttggtatggtaatctaccgtgaagtaaaatttaaagatctggtagatatctttgtagagtctgcaaagacaaccggtggtatcatgctgatcgtagcatgtgcttctttgttttcatttgtatgtaccaaatttggtatttcgcaggcagcgtcaagtctgctctccagtgtagcacataatcagtttacgtttcttttaattgtaaatgtaatcttcttaattgcaggatgctttatcgatgcaaactctgcaatgtatatttttattccgattatgcttccggtttgcaaagcacttggatatgatttagtcgcctttggtattgttgcaacggtcaaccttgcaatcggacaggttactcctccggtaggtgttaatttatttgttgcaatcagtgtcaaaatcaaaaaaggactggaagttacccttcaggaaatttccaaagcggtgctcccgatgattgcagcctgcgtagttgtccttttgatggtgacttatattccgcagatttctacttgtctgccaaaactcttcgcaggaagttcttatacaggaacatcgaaacttgcagcagatgattctgaggcagaagagagccagtctgatgatgactataatcagattgatgattacagtgaccttggctgggaagaacagacctggaactttgcatgttctaccaccgaaaccagtacctgggcacaggccggagaacagtttggaaaattaatggaacaggcaaccggcggtaaagtaaaagtaaatgtatacgcagcagaccagctgacaaacggaaatcagtcagaaggcattcaggcacttatgaacggagatccggtacagatttccatgcattcaaacctgatttattctgcatttgatgcaagatttaatgttgtatctttaccatttatttttgattctgtagaagatgcagatgcgaagctggatggcgaagcaggacagaaattagatgaaatcttatctgagtacggacttcactgcatgggtatggcagaaaacggattcagacagttgacaaactctgtcagaccggtaacttccgtagacgacatgaaaaacttaaaaatccgtgtagcaggctctaacctgttaatggaatgttacaagagatggggcgcagatgcgaccaacatgaactggtctgaaacttatacagcacttcagcagaatacagtagaaggtcaggaaaatccacttccggcaattgatgctgcaagtgtacaggaagtgcagaaatactgctctatgtggaatgcaaactatgactgtctgttcttctgcatcaaccaggatatctacgatgcactgacaccggagcagcaggctgtagttgatgaagcaggtaaaaaagcagttgattttgaacgtgatatcaaccgttccggtgacgatgaaatcaaatcccgctggtcaaaagaaaacggtgtggaaatcacagagtacgaagaccttgacattggttctttcaaagatgcagttgcggacattccgcagtggtatgaagaacagctggttgcagaaggatttgacgaggcagaagtaaaagatttaattaatgtatttactgcaaaaagcagtgcaggaaattatgaagtagaggacagaagtgacttagactggaaagaacagacctggaactttgcatgctctactacagaaaccagtacctgggcacaggccggacagaaatttggcgaaatgatggaacaggcaacaggcggcaagattaaggtaaatgtgtatgcagcagaccagttgacaaacggaaaccagtcagagggaattcaggcacttatgaatggagacccggtacagatttccttacattcaaacttaatttactctgcatttgacccgagatttaatgtggtatctcttccattcttatttgattccgtagaagatgctgacgcaaaactcgatggggaagccggagaaaagttaaaatctattcttgaagactatgatattcattgtatgggaattgcagaaaatggattcagacagttgacaaactctgtcagaccggtaacttctgtagatgacatgaagaatttaaaaatccgtgtagcaggttccaacctgttgatggaatgttataagagatggggcgcagatgcaacgaacatgaactggtctgaaacttatacagcacttcagcagaatacggtagaaggtcaggaaaatccacttccggcaattgatgcagcaagtgtgcaggaagtacagaaatattgttcgctgtggaatgcaaactatgactgtctgttctttggaatcaatcagggtgtttatgatgcactgacaccggagcagcaggaagtagtcgatgaaatcggacagaaagcagtacagtatgaacgtgaaatcaatcgtgcaggagatgacgaaattctctcccgctggcaaaatgaaaacggtgtagaagtactgaaaaatgaagagcttgatgtagagtccttcaaaaaagcagtagatggcattgacgaatggtttgtagaagaattaaagaaagccggatatgatgacggtcaggatcttgtagatgcatttgaacgcagataagcattcccccgtttcaagtgcgcagagcactaagcggcgggtgaaggggatgcttctgtcagtgagagttgaaagctcccactgacagagcgcaaagcgactgcgttcatgagcaagtagcgaagtggattgcgaatgtccgctttactgcagataagcattcccccgcttcaagtgtgcggaacggatcgcgaatgtccgctttacaaataaaaaattgtaaaaatgtaagttttagaaagccggatacttttttggaagtatccggctttttttgaatatattgttataacaagtaaaactgagaatttggatagaaaagaatgaagcgaataaaaggattagccggtattacgattttattttttatgctaatcgccgtggcaggtttagatggagactttgataaaaaagaacaatctgtatttggagcactttcagatgaggaacatccgaaaattgcactgacctttgatgacggaccccatccggtttatacagaagaactcttagatggtctaaaaaagcgaaaagtcatggcaactttttttctgattggaaataatatcgaaggaaatgaagagattgtaaaacggatggcagaagaaggacatttaatcggaagtcatacttataaccatgtgcagttaaataaactttcagaattgaaagcgaaagaagaaatattaaaaggctgtaataaaatttatgagacaaccggagtctgcccttcatttgtgcgtccaccgtttggggagtggaagaaaaatctggatttttgtgtgaccatgcttcctgttttctggaatgttgattctcttgactggaaactgcaaaatacagaaaaaatcgtaaaaagggtagtgaaagatgtgaaagaaggtgatattattttaatgcatgatatttttgaaacttccgttcaggcggcatttcagattattgatacgcttgaaaaagaaaactatgaatttgttacggtagatgaattgcttttggaataaatttaagcaagaagctcggttgcttgtagccgagtagttcacgaactatatagaaaacgtattttaaaaaatgtattttacgaaatggagaaggttatggatttatttgattatatgaaagaacagactttagaaaacgaatctccgcttgcttcaaggatgagaccggtttctttagaagaggtggtaggtcaggaacatattattggaaagggaaaactgctttatcgtgcgattaaggcagataaactgagtagtattattttttacggacctccgggaaccggaaagacaacacttgcaaaggtgattgcaaatacaacaagtgcaagattttgtcagatgaatgcgacggttgccggaaagaaagacatggaagaagtcgtaaaaacggcacaggattatcttggaatgtacggaaaaaagacgattttatttgtagatgagattcatcggtttaataaagggcagcaggattatctgcttccgtttgtagaggatggaacgctggttttaatcggggcaactacggaaaatccgtattttgaagtaaacagtgcgttgatttcacgctcaattgtgtttgaattaaagtcacttgaaaagaaagatattgataagctgcttttaagggcggtatcagataccgaaaaaggaatgggtgcttatggtgcggtattggatgacgatgcaagagaattcctttcggatattgcaggcggagatgcaagagcagctttaaatgcattagagcttgccattcttacaaccgaaaaaagtgaagatggaaagatacatattacattagaagttgcctctgaatgtattcagaaacgagtagtgcgttatgataaaaccggagacaatcattacgatacgatttcggcatttatcaaaagtatgagaggttctgatcctgatgcagcagtttattatctggcaaagatgctttatgccggtgaggacattaaatttattgcaagaagaattatgatttgtgcttcagaagatgtaggaaatgcagatccacaggcacttcaagttgcagtttcggcagctcaggcagtagagcgggttggtatgccggaagctcagattattttatcgcaggcagttttatatgtagcgtgtgcgccaaaaagcaatgcggcatatatggcggtttttgatgcaatggaaaatgtaaaacaggtaaaaacaaccgttcctccgcatcttcaggatgcacattataaaggagcgtcaaattttggacgtggaattggatataagtatgcacatgattatccgaatcattatgtaaaacagcagtatcttccatctgagatagaggggacgaaattttatcatccaagtgaaaacggatatgaaaaacagatacaggaacatttaaaaaaaattgctgagcatgctacatgagcatgtccagcagtttttcatatacggctttattttttgtctgccaggaagcacacacggcttcagcggcagcttttgtcggaacggtcatagttaattcaataagcggtacttctttttcttttgcgctgcatcgaacctgataaccttctttttctcctctgtaataattggcaaaggttgaaagttcttccttgatttccattgcattatttttgaaaaattcagcaatttctcctttgatttctttaggaatttcttttccgaaatactcaagtgtctgttctccggattttgtaatcgagaaataagaagaatttcggatagtttcgcagtggattaactcggattcggttaactctgaaagtgcctgctgtaaatggaaataggtagtatatcctttatcaagaataaatccggaaatctgtgcgttggttagtggaaaatctaccttttccagcatatagagtacaataagtttatataaagtaagtgattctcccatgagagtcctccttttaaatgtaatgttctcttgaaatcttttatgatagttacagaaaaaatccaagagtacatttgtgataggttttcaggtttcatgaaacagtctgccctgccaggtgtttcggattttacactcatgatgaagggtgtttaatactgttttttttgcgctgctccataaaggggcgattaaaagtgcttttggaccgtctcctgttacgcgatggacaacgatgtctggtgaaaggcgttcgaggcagctgatgaccaaatcaatatattcttccatggagtagactttaaatttaccatccagataatcagaagctaaatcggttccttttaaaacatgcagaagctgaagtttaattccctgaatgtctttgtgatttaaataatcaatcgtttctaaaatatcttcttttgattcgcctggcagtccaagaatggtatgcacaatgacttcaagccctgcgtcttttaaattttttactgctgtttcaaaacaggagagtgagtagcctctgcgaatgtagcgagcagtttcttcatgcatggtttgaagaccaagttcaacccagacaggctttatctgattcaaacgttttagaagtgcaatgacatcgtctccaaggcaatcggggcgtgtgccgatagaaattgcgacaacatcgggataagaaagtgcctctgtaaaaattttttccagatagtcaacgggagcgtaggtgtttgtgtacgcttgaaaataggcaataaatttttttgccccacgtttttctctaaggcggtcagcctgaatcttaatttgggtggtgatgctgtcacgggaatttccggcaaagtcgccggaacctccggcactgcagaaaatacagcctccgtttccgagtgtaccgtcacggtttggacagctcattcctccatttaatgctactttataaactttggtggaaaatcgttcctttagcattgcatcgaatgaatagtaaggttttccattccaagaatttgccataataattcaatgactccttccagtttttcttttagctctatcataccattagcaaaatccttttgcaagaaccgaaggcacatatttgacaaagaagagggagcatgatatcgtagtgttagcaaaaaggaatgtatgcgttaacaaaaacaaaaagtgaggtaaaaactgtgaaaaacataagaagaaaactgggagcagtagtgttagccactgttttaatgataatttccctgtcgggttgtagtgcggggaatacatcttctgatggaagtatttctactatagaaaagggagttttaaaagtcggaatgaatttaaatgattctccgatgagttatttaaataccgataccgcaagaccggatggatttgaggcaaaggtagcagagcaggtagcggaaaaacttggattaaaacttgaaattatcgatactacccagaaaaatttattaaaatcattagatgcagacatttatgattgtgtgatttcaagtgttggcatgacagaagaaaactgtgaaaaatatgaagcaacaaatgcttatgcagatgtcagtgcgatagaagatgagttaactgaaaagccgaaaaataccaaaattgctatctttggtaagaaaaataatggattaattcaggcaatcgaaaaacaggcattagagccgttaaaagaggatggaacactttcagaaatttcaaagagttcgttaaaagaaaatattattataaagtaaaagaaaaattctacttgcaaaattgcaagtagaatttttttataaaaaaagcaaaaaacgacttgattttttttacattcgatggtagcataagtatatagtttaatgactaaactaattaagaaggaggtaacgtcccatggaaattttaaatgtcatggacaaagcatttgctccatacggaaaagtcgtaacaggacttaacgtaagcgatcttctggctgcacttgagaaaacaccaaagccggatgatgttatttatgttgcttcagatgaagcccttgaagcctgtccaagcgtagataagattgcttacagtctttttggaggaatgccgattcaggtaggttattgtaatggaagcaattatctgttgaatgcagtggaataccacagagatagtgaagtcaatgtagcattaacagatttaatcctgattcttggaaaagagcaggacattgaagctgatggtacatatcagacagagaagatggaagcatttcttgttccggcaggaacggtcgtggaagtatatgcaaccacccttcactatgcaccatgtaatgtaaatgaaaataagttctgtacagcagtcattcttccgaaaggaacaaacgaagatgcaccggcaccacagaacaatacagcagaagacaaactgctttttgcaaaaaataaatggctcatcgcacataaagatgcaaaaatccagggcgcttttgaaggattgattggagaaaatctttccgtaaaataagaaatttaaaatcaaatttttagtttcatttttcaggaggaaaataaaatgaatttatcaaatatgccacaggcaaaattaggtattgtagcagtaagccgtaactgtttcccaaaatctctgtcagaaaacagaagaaaagcagtagcagctgcttataaaggtgaaatctacgaatgtccaacagttgtagaaaatgaaatggatatgaaacaggcattaaaagaactgcgtgaagcaggatgtaatgcattagttgtatatcttggaaactttggaccggaaacagaagaaactttactggtaaaatacttccatggaccagctatggttgttgcagcagcagaagaaagaggagacaacttagtacagggtcgtggtgatgcttactgtggtatgcttaacgcaagctacaacttaaaactgcgtgaattaaaagcatatattccggaatatccagttggaacaccggaagaagttgcggatatgattgctgaattcgagccaatcgcacgtgcaatcgttgcaatcaaaaacttaaaaatcatcagctttggaccgcgtcctacagacttccttgcttgtaatgctccaatcaaacgtctgtatgatttaggtgttgaaatcgaagaaaactccgaacttgacctgtttgaaagctttaacaaacatgccggagatccacgtatcgaaggtattgtaaaagaaatggaagaagaacttggagaaggaaataaaaaaccggaaattcttccaaaacttgctcagtatgaaattactctgcttgactgggtagaagctcataaaggtgcaagacagtatgttgccctgacaacaaaatgctggccggcattccagacacagtttggttttgtaccttgctatgtaaacagccgtttaacaggaagaggacttccagtatcctgtgaagtagatatctggggaacattaagtgaattcattggtactgttgtaagccaggatatcgttactctgcttgatatcaacaacacagttccggctgatatgtacaatgatgaaatcaaaggaaaattcaactatacacataaagatacattcatgggattccattgtggaaatacagcttcccagaaactgtccttctgctctatgaaatatcagatgattatggcaagagcacttccggaagaagtaacacagggaactcttgaaggagatatcatccctggagatatcacattctatcgtctgcagagcacagctgactgcaaacttcgtgcatacatcgcacatggtgaagtgcttccggtagcaactcgttcctttggtgcaatcggtatctttgcaattccggaaatgggacgtttctatcgtcacgtactggtagaaaagaactatccacatcacggagcagttgcttttggacacttcggaaaagcgctctatgaagtatttaaataccttggcattgatgtagaagaaatcgactacaaccagccaaagggaactctgtacccaacagaaaatccatttgcataatttttgcaggtaagaatcaaaaatggaggctgcccgaaagagcagcctcttagtgaataaggagaagaaaatatgttatacattggtgttgaccttggtacatccgctgtaaaattactgttaatgaacgaagaaggcaaaattgaaaaaatcgtttccagagaatatcctctctcttttccgcatccaggctggtcagaacagaaaccggaagactggtggacacagagtattgagggaatcaaagagctgacagcagaatgtgataagagtcaggttgcaggtatcagctttggtggacagatgcatggtcttgttatcttagatgaaaatgatgaagtcattcgtccggcaattctttggaatgacggaagaacaacaaaagagactgcttacttaaatgaagtaatcggaaaagacaaactctctgagtatacagcaaatattgcatttgcaggatttactgcaccgaagattctatgggtaaaagaaaatgagccggagaatttcaaacgtatcaaaaaaatcatgttaccgaaagattatctggcatataaattatccggtactcattgcagtgatatgtccgatgcgtccggtatgctgttaatggacgtaaaaaatcgttgctggtcaaaagaaatgcttgatatctgtggaatcacagaagaacagatgccgaaattgtttgaaagctatgaaacagttggaacattaaaaccagaacttgcagaagaactgggaattccggcaacctgtaaaatcgtagcaggtgcaggtgataatgcagcagcagcagttggaaccggaactgttggtgatggaatgtgtaacatttcccttggaacaagtggaacaatctttatttcaagcaaggaattcggtgtagatccacacaatgcacttcatgcatttgctcatgcagatggaaattatcacttaatgggatgtatgttaagtgcggcttcctgtaataaatggtggatggatgaaatcatcggaacaaaagattatgccggtgagcaggcaaaaattgaaaaacttggtgaaaataatgtatacttcctgccatatctgatgggagaacgctctcctcacaataatccaaatgcaagaggaactttcattggtcttacaatggacagcacaagagccgatatgacacaggctgttttggaaggtgtcgcttttgcaatccgtgattcctttgaggttgcgaaatctcttggaattaagattgaacgcacaaaaatctgtggcggcggtgcaaagagtccgttatggaagaaaatgattgcaaacatcttaaacatcaaagtagatgtaattgaatccgaagaaggaccggcacttggcggtgcaatgcttgcagcagttgcaaacggagagttcgcttccgtagaggatgcagcagctaagattgtaaaagttattgatacggtagaaccggaaccggaactggcagcaaaatatgaagaaaaatatcagaaatttgctaagatttatccgacggtaaaagatttatttggcgaattactgtaatagatattcaaatttgaacgcagataagcattcccccgcttcaagtgtgcgaagcactaagcgggggaggggggatgcttctgtcagtgggagttgaaagcttccactgacagaacgcgaagcgactgcgttcatgagcaagtagcgaagcggattgcgaatgtccgctttacagcaggagacagtgtacagaaaattttttctatacgctgtctttttttgcgttgtttttacgatgttaatgctatagtgtaataggaaaacatacttgattttgaaaaataagagcggtataataaaagccctgttagcaagaaaaaattttacagaggagaaggaataaagactccgagaatacataattgaatcaggaggagagtatcatgaaatacgtactggatgtgcacacacatacgattgcaagcggacatgcctataatacgattaaagaaatggcacagtctgcatcagaaaaagggctggagttgttgggaatcacagaacatgcaatgaaaatgccgggaacctgtcattcgttttattttgcaaatttaaaaatgctggaacgaaagatgtttggggtagaaatgctgtttggtgtggaacttaacatcttaaatcaagacggtgaagtagatatggaagaaaatctcttaaaaaaaatggacatcgtgattgcaagtatgcatataccttgctttaagtctggtacaaaagaagaaaatacacagacttatttaaaagttatggaaaatccttatgtgaatattatcgggcatccggacgatggaagatttccggtcgattatgaacagctggtacttggagcaaagaagcatcatgtacttctggaagtgaataataactctttagaccctcgctgtaccagagaaaatggggaagagaatgtaaaggacatgctttgctattgtaagaaatatgaagttccggttgtggtggatagtgatgcacatacagatgctctggttggctgtcactgctttgccgaaaaagtaataaaagaagtagattttccggaagaactgattataaaccgttcagtagaagaactgaaaaaatttcttaataagtaaattttgaaaatactgctttactttaaaattttagtgtgttaatataggaagaagagaagtcatattggggtgacaaaaatatacgttatgataggagagttagaattatgagtaaaaaaattcatacagaagcagtcgattctttatttgatgcgattttatgtttaaaagatagagaggaatgttatacattttttgaagatgtatgcacaatcaatgaaatcttgtctttgtcacagcgttttgaggtagcaaagatgctcaaagataagagaacttatcttgatatttccgaaaagacaggtgcttccacagcaaccatcagccgtgtaaatagaagtctgaactatggaaatgacggatacgaaatggtatttaagagaatggcagaaaaaacagaagaataaaaacagaaaagaaaaagtcaggagaggaccttttaaaaataaaaatgtgtacctctccatttttttgagaatttttacaatttattatttcttactgttcttattcttatttttcgtctctttgggctggttatctgccatatcgtctataatcttttcgataacctgttttttaacatatacgtcaaaactgagcatacagatgaaagagaattttcggagaaaatcctgctcttcttctgttgcgtgctcaaaagaactgcaggcaagtttatattttttggtcacgtctttggcaagtggctcaatctgcttaagttctaagttcataatttcattatagagttcggtcatatccattgagccgtcaccggaaaaataattttgggaaatcgggtcaagcagggtctggatatcattgatacataaaatattttttaaataataaataaaagtaagcattaaaagatgctcttttgaatatttctttttgaccggtggaggtaacaggttattttttgcatagttgttaatcatggttttcgtcaggattttatctccttcatgtcttcttgaagaagaaagatgactctccataaatgtcgttacctgatccatatataaatcaatttccggaatttcttcgggtttaatataagaaatacgagaaatgctttcaagaatactattgagcatgtcttttgtgtcaattgtcattttatcacctctatgctatattatatagttttcaaaactatttgtaaacgaatttctgtaaaattttcacgcttgaagccgataaggggagtatggtatattgtagaaacaggtgacactgaaaaataattttaaagaaggtgcaggtttatgagtatatatgataccttaaatccggaacagaaagaagctgtcttacagacggaaggtccggttttaattttagcaggtgccggttctggaaagacccgtgtgctgacccatcgaattgcctatctgattgatgaaaaaggggttaatccgtggaatatcatggcgattacatttacgaataaggcagcaggtgaaatgcgggaacgagtggataagattgtgggatttggctcggaaagcatctgggtttcaacctttcactcaagctgtgtgcggattttaagaaggtacattgaccgcttgggttatgaaaataattttacgatttatgataccgatgaccagaaaagtctgatgaaagaagtctgcaaaaaactgaatattgacacgaaaatctataaagaacgtgcgattttaggtgcaatttcttctgcaaaggataatctggttggcccggaagaatacgaaaaaagtgtgatggacgattacggccggaaaaaaattgcaatggcgtatacagagtatcagaaagaattaaagaaaaacaatgcattggactttgatgatttgattgtaaaaactgttgaattgttccagagctgtccggatgtgctggattcttatcaggaaagatttaagtatattatggtagacgaatatcaggatacgaacacagcgcaatttaagtttgtcagtcttttagccggcaagtatcagaatttatgtgtcgttggtgatgacgatcagtctatctataagttccgtggtgcaaatatcggaaatattcttggatttgagaagatatttccaagagcaagagtaattaaactggagcagaattatcgttccacaaaaacaatccttgaggctgccaatcaggtcattcacaataatattggaagaaaagcaaaaacgctttggaccgataatgaaatcggtgaacccgtgcattaccgtcagtttatgaatggttatgaagaggcagaatatatcgcaggagacattagtaaaagggttcgtgagggagaatgtgaatataaagactgcgcaattctatatcgaaccaatgcacagtcccgtatgtttgaagaaaaatttttgatggcaaatattccatacagactggtagggggcgtaaacttctatgcacgtaaggaaatcaaagatttgctggcctatttaaaaaccgtagataatgccagagatgaccttgcagtgcgtcgtattatcaacgtgccaaagagaggaattggtgctgcaagtctctctaaagtgcaggattttgcagaccagaacggaattggattctatgatgctttgcaaagagcagatgaaattacaacacttggacgtgcagtatctaaaattacaccatttgtaacctttattcagagtttaagaagtaaattggactatatcagtccgtctgaattattgaaagatatcattgacgaaaccgggtatgtgacagaacttcaggcagaaaaaacagaagaagcggaatctcgaatcgaaaatattgatgaattgattacaaaagtggtaagttatgaagaagaatgtgaagcaaataatgaggaaatcagtttaagcggtttcttggaagaagtagcgttgattgcggatattgacacggtagatggagatgacaaccgtgtacttctaatgactcttcacagtgcaaaaggtttggaatttccttatgtatatctggcaggaatggaagatggcgtattcccaagttacatgaccattgtgtcagatgacccgactgaaatcgaagaagaaagacgtctttgttatgttggaatcacaagagcgatgaaagatttaactctgacctgtgcacagcagagaatgattcgtggagaaacccagtataataagccgtccagatttatccgtgaaattccgaaggaattagtagaccttggaaaaaatttcaaagaaagaaaagtaaaagaaattccgcttccaaaaggctaccagcagatgaaaaaagcaatcaaagagccggcatttatgcagaaaaaatttgaggtaaaaaaagcatccagcctttcttatgatgtgggagatactgtcaaacatatcaaatttggaactggtgtggtaaaatccattgttgatggtggaagagattacgaagtaacggtagattttgaaaaagcaggcgtaaaaaagatgtttgcctcctttgcaaaattaaagaaattataacattatttcaaaatgcaaaagataaaggtacaaatacgggaaagaaaagatagtaaaattcccataagcgtgatataataatggaaacagccaaagtaacggacttaaagttgccggaaagtaagtttctgtgcaagagaggaaggtgtagtatcatgaatcgtattgaagatttagtagcagcattgcagaaaagggaagaggagaaaaataaaaatacagttttatggattctcgcaattgttggagctgtatctgtagttgcaggaattgcttatgcggtttatcgtttcttcacaccggattatctcgaagattttgaagaagactttgatgatgatttcgatgactacttcgaggatgatgaggaaaacgaagaacacgaagaagataaggacgaagagtaacaaaataataaaaagaagcttcgggaaaccggagcttcttttttagaaagaatgaaatagaaaataaagaagaataaatagcatcagatatggaggtcgaacatttgaaaaaaggtgaaatttatgaaggcgtagtagaaaaaattgaatttccaaataaaggaaaagtaaaagttggagaagaaacggttattgtaaaaaatgcaatcccaggtcagaaagtccgttttatgataaataaaaaacgtggaaaaaaattagagggacgtcttttggaagtattagaaaaatctcctcttgaaaaaagagaaccggtctgtagcatttttccggcatgtggaggctgtatgtatcagaccatgtcttatgaagaccagcttaagatgaaggcaaagcaggtaaaagaacttttagatacagcagtaaaaaatggtggacaggtagacgaaaacggaaatccggattatgtatttgaaggaatcaaaggaagtccatttgaatttgcttaccgcaacaaaatggaattttccttcggagatgaatataaggacggaccgcttgcacttggactgcacaaaaaaggcagtacttatgatgtgttaagtgcccgtgactgtaaattggtacatgaagatatgacaaaaatcctttgttgtgtccttgaatattttcaggaaagaaagaccagtttttataaaaaaatgcagcatgtgggctatctgcgccatctgctgttacgccgtgccaacacaaccggagaaattttagtcaatctggtaactacaagtcaggaagaaatggatttaacaccattaaaagaagcacttcttgcattggatttggaaggaaaaattgtgggatttcttcatattatcaatgatggattatccgatatggtaagaagcgatgagacgagaattctttatggacaggattacttctacgaagaaatcttaggattaaaattcaaagtgacgccattttctttctttcagccaaattcttacggtgcagaagtactttacaatactgcaagagaataccttggaagtacaaaagatatgaccgtgtttgatttatatagcggaaccggaacgatttcacagattttagcaccggtagcaaaagaggtaattggtgtggaaattgtggaagaagcagttgaagcagcaaaagcaaatgcagctttaaatggaatcgaaaactgccactttatcgcaggcgatgtattaaaagtgatcgatgagatcaaagaaaaaccagatacgatcgtgcttgacccgccaagagatggaatccatccaaaagcactgccaaagattattcagtatggagtggataagatcgtgtatatttcctgtaaaccatccagtttggcaagagatttggaagtgttcttacagagaggatatcgagttgaaaaatgtgtgtgcgtggaccaattttgtcagacggtgcatgtggagacggttgttcttttgtcccaacaaaaaccagatgacacgatagagatcgacttagacttagatgagctggatgcaaccagtgcagagacgaaagcgacctatcaggaaatcaaagattatgtgctgaaagaatttggcttgaaggtttcaaatttatatatttctcaaatcaaaaggaaatgtggaattgaagtaggagagaactataatctgccaaagacagaaaatccaaaagtgccacagtgtccgaaagagaaagaagatgctatcaaggctgccctgaaatattttgcgatgatttaaggatatcgctgatttcaaggaggaataacacatgaaaagcacatttgaaaaaatgggtggaacctacacactgggagcagacggaatttactatccgaatcttgtcagtacagatgaagaaccgcattatggaaaatatggaataatgcggaaaacgtatctgaaagagcattgtccggcaatgtattcactgtatatgttggaagacagactggtggaacatctgaatcttgtggatgatgaagcgcaggagagaatggaagttctggtgcatcagatgatggagaggcagggcattacggaagaaatgaaagctcgtgaccagatggaatgggttagggcggtaaatggtattcgtaatatggcagaagagattgtgttaaaagaattgatttacaggtaaataaagagctgaacaggtaggaagaaaactcctatttgttcagcttctgcatttgtaagggttcaaagaagaatcaaattacaattccatatcaggtgaccatttctaagttccggaaggttgtttttttctgccatggttataagttacacagatttaattacttcatagtatggcttaaaaaatatccgaatataacttcacagaaataattataatggggagattatttgatatatttgtgctaatattctgcaattctactgctagtcgattgatttatgcgtactcccattataatatgtgtgcaggaggtggatgtatgtatcaaattagtaatgaaaaattcggtttatttgtaaccgaattaagaaagaaaaagaatttaactcaaaaggatttggctgaaaaattatatgtatcagataaaacggtcagcaaatgggaacgtggtcttagtatgcctaatgtcgtattactcataccaatagctgatatattagatgttaccgttacagaattgttacgtggagaaaaaatagatacacagaaaaatattgatacaaaagaagtcgaggaattggtagtaggctctctcgatatggctgttaggaattctattcatcagcatagaaaaaactggatattagcatatttgctatgctttttaatatctattacagaaattattatgttagtcgtatctgggaattcaatagctgagatgaaagatgatatattgctggttacagggttaatgcttttatttggtgcatggttttgtttctttgccaaagacatattaccaacatattatgatgcaaacaagataaattatgtttcacaaggaatttttagaatacatctagttggtttatcctttaacaacggaaattggatgtacatctgtacaactttaaaaatttggacacttgcaacggttgttctatatcctcttgcaggtattataataatcaattgtctcaatatagctttatgggatattttaagtaaaattttcttaattatgatattaggtggtatggtagtttcgatttacattatcgggaaaaaatacgaataattaaattacctgttatcgttgtggatattactaatttacaacattcttcatgggaaataagaaatgatgcagaagagattgtgttaagcgaattagcatacatttagaacgtggaaagctccttcgggagcttttttctggtttttgctgggtatcaagaaagtatatagaaaatgcattaatcatatggtatgatttgaacagaagatagaatcttaggaagcaagaagatttttgaggaatgtaacttagaagttatagaattaagttaatcgtgccatatggcttgattataaacgcaaagataaaaacgcaacgtacatctttgatgtgccagagccggtaggtagcccggccgtcctatataaatagggtaagtaacctgcccctccgggttgtccattctttgttcaatcaattttaggagggattcttatggacaaagtaaatggaaagctgacagtattttttgaagagccgttttgggtgggaatctttgaacgcatcgaagatggtaaactatctgtggcaaaggtaacatttggtgcagagccaaaagattatgaagtacaggaatatattcaaaagtgctatttcagtttgaaattcagttcggttgttgaaactgttgtaaaggatatcaaaagaaatccgaaacggatgcagcgggaagtaaagaagcagatgctggaaataggcattggtacaaaatcgcaacaggcgttgaaattacagcaggaacagaacaagcaggaacgcaaagagaaaagacgcaagaaaaaagaggcagaagagcagcgaatgtttgaactgaaacagcgaaagaaaagagaaaagcataagggacattaaagtcccttggccttttactcaaatcgaaaagtgttgaataaagctttcgggaggtgtttctatgaagaaaaaagtacttgcaattatgttagtcgccatgtcaatcatgttgatttcagcgtgcggaaaaaaagaaaaattgtacgaaattcctgatttatcgcagtataagacagattatgtaggagattcttcaaatgttataaatattgtaagcggtcaagagtatccagagggatactcatatgacagtatagagatacagtctgaaacagagccttatggattaacagtttttctaaaagatgagccgtcggcagtcaaacttgaagatcaattgcaggttaatgcagatatgacatttgacttgattggtaatttgggaacaattgattataaaacagcagatagcaaagaaattattgcatcatatgaacggtgatatatttttagtcaacttttagacaatttgaagaacggaatataaaaaggcgtatggaagttttaaatccatacgcttttttgaaaaaaactcatttttgaacaagagatttgtaagaacatattatctattcaaagacggttacaattccatatcatgtgattttttcttagattgagcaggctgatttcgccgtatttcccgtttcctctgatatttcagttcccatgcacgatgggagaagacatcaggatcttccacattgagataatccacctcattggctgcaatatcacgacggtgatagtcataatatttaccgaaagtacctttaagctgttcgatcagcttatcccgaaaatcaggacgtatctggattctggtgtccagcaattctgtgtattgttctggatcaggacgaaatttttcttcccggaaagcaacggcgtctttttcaagctgttttttaagggagatgtcctgagaatcaagaatatcaagattgttattcatctggtcatatttcttggatagattcatcatatctttatcagtagagcattgtgcctggaagattagctgctctttccttgatttcagttcttcaatttcttcggtaacagttgtaagctgctgattcaattttatatgctggatgggattcaaaatactggttttctctttttctacattcagctctttccgttctgtaactttagctttgagtttctttttaacggtgttgtatttattcagtattggattaaaatgattcatccaatcatgaattacttctttttgcatctcattatgaagtaaatgatattgtgtaaagatcatatgatttcggatagtttccattgtttctgcaattacaggaatagaatttttgacagcttgagccagtttctctacctgagcttttaattcccggagcatttggttatctgcacgaatctggcggttgatttcacagcggtcagctatcattcctttcttttccatgttttgagcaatatagccttcgtggatggtcggctgttcggtgattccctgatctgcaaagctgcggtgatcaatggatgcatttatctgattgtgggcaagcatttcatttacagtatctgcccagtttgctctccagatacagagttgctcatcactgttccattgttcagaaatgggattctgtctgccatagcggctgctttttggatgcttgtcgatgcggtcatagcctttttcctgtgcgacagatgcggtcatataaactttctttttcccaactttatatctgtattgcttttcccagccatctttttgagcagctttgaattcagtagctgtaaatcctttttcttctccattttttatgcagagatattctttttttgttttatactgccatgttccgttttcgttcagtggacggacggtaagcagaatgtgtgcatgaggattgtgtccatccgtatcgtgaatagcaaagtcagcgcacatgcccatatctacaaagttcttttgaataaaatcttttagaagagaaatattactgtccttatctaattcaacgggaagtgcgacaacaaattcccttgccagtcggctgtcttttgttttttctgcagcttccacagcattccagagttgttcacggtctttccattctggtgaagccatcggtggaagcaatacttcctgataaatgagtccatgctttctggtgtaatcatgctggatgccatcgtaatcattgtacatccggctgcagctcatataagcagaagctgcgacagcggaacgtccggaaccacggctgacaactttggcttgcatatgataaattgccatatctggcacctcctttcgatgttgcctgcaacagcggaaaagccctcggcagagcgcacgagccccgtaggggataccaccgcccgatttatcgggtggtgagtaagtgcgcccttcgggagtagaacttgtgcgtttacattcctcgtagccggattatcagctcccgtttcagggaatccaaatccatttctttaatatggggaacaatactttccaaaatggctccttcctggactaatcggtgtgttctggcatcacgttcttttttgcgatttcttgcttcggcttcttcttggcggtgtcttgcctgtaaaagtgctttttcttccggtgtcatgatttttttatctgccatatctggcacctcctttttatgcccgtatccgggcagtattggttttaaaatcttatggtttggtactatagtttcggataactgacagtggcatgtttctggtgataaataaggaaagaaagtagtaccactgtcagtgaagaataattatcgtgttatgcttctttgcttcagttctggttcggagcatgattgtttaacagaattctttttgcctgttttaaattagctgttgcattgtcctgacgaatattccggttattgatacggacaggaatacatctctccagaatacggtcataaattcgtttgtgtgcgatatcagcggcgttattcagctctgataaagtgagattggtcgttatgatcaggggctttttactgcggtaacgactgtcgatcacattgaatacctgttccagtgcaaagtcagagttccgctcaattccgagatcatcaataatcagaagactgtagcggtttaagctgttgatgaactggtttctgtcttcaaaatgcattccggtaagggtatttagaattcgggaaaagttggtcatcagtacaggaacgcctttttccagaagggcattggcaatgcagcctgcaaaaaaagattttccagtaccgacatcaccccagatgagaagtccggaagcatttgctctcatctcttcccagttgcttacataattgtgtgccagttttatttccggattgatgccgttatccctggcaaaagtgtagtcatagagtgctttgtcctgtaagccgctggttttaagatgctctatttccatttgtttttcatgaagttttctctgggcttcttcctgctcaaagatttcctgctggcatttacagcggatggaaggaataagaacctttccctgtaattcatgcctgcattgccttggcgtattgcatttggaacagtagatcaggtggtctgtttcgttaaaatattcatcagactgaagctctctgtttggggttatagctgttggtttttctataaattttgtcataatgtttcgtattcctcactttcgtaatttcgttgtcgggaagcaggatgatcctgtcttgcccaactgatgatggtagctgcgtggttctgatattgctttccggtagaagccatataaccggataagcgttcaatataatccttccagtcagggattgtctgccggatatcttcaagctctttttctgacagaaaaacattttgaaattttccatagggtgagagtggctccttactccctcttattgctaaattgttcttttttatctctttcttattaccagacagttttctgtctgtatcatggaaagaatcctgtctgtcaataggacagttttttgtctgtcttagggaaagaaatctgtctgtatagtggatggtttcttttgggagttttacataaatccgattgggctgtccgggaccctgccgttttcggaagataagctcctgtttttccagtactgccagagcagttttaaccgtcatctggcttttgtggagaacttctgccagtgcttcaatcgtaaagtaaatgaacacatgaccgtctgtatctgaccacccctcatttttctgggaaagccttgcccggtcgagcaggataatataaagcattttggcagtttcgtttatttccatgtccagaaggaaacggggaaacatcatataagatggcaggttggtgtctgctgtcagaaagtcagtcatgtgttcacctccaatcaaaagggtttattccccaagaaaatcccagtctacatcactatctggctgtgaattttcaggtgctggaaaggatgccctgatttggggctccctttgcgccatgcctgcagtcagtccggaaagaaaaagtggcaatgcctgtttcagactgttttccactgcatctacaatctgtttcacaaaaagttcttcccgttctcttgtttccagataaggatcagcctgtgtgcggtagtagcggtcaaaataatctaccagtgcaagagagattacctgactgtaagatttaaaatcctgcctgtccatcgtctgtaaatattcccaggctctccgttgctgttctttgtccagattaaagcgcaggtttgtgttgcggatattgttctgcatggtttatcccctccttttcaggctcatataagccagagattcgtaacctttggcggtggcgcagatgtcatcaatgatggtgactcgtaatttgtcatacgttccgaagttacggatcagacatccaccgccgccaactacatacaggcgcattaggtcaggattgtattcatatttgcggagtgtggaaaaaagttctgccacatactgtctggcaatagaactgatacaatccatatatggtgctgaaatgtcagctgttccaaaccgcagaatctgttctactgtagattcttcaatcttcactccaaatttgtccagaacagcgttctttgcagcaatcatgcattggtttacaccaagtttttctgtccagcatcggctttcttgtgctttcttattgttgatatacagaatgttcatggttccgtttccgatatctgcaaggagattagttcccttgaaatttccaaggtggtttacaatagccggatatccctgtgggtaaaggctacatcccacaaagcggagatgatattctttgccgttgaaacggaaatggacttctggattctggagcagataggaacgaaaagcttctctttgatttctgatccatgtcagaggaagtccggcagccagatgaacatctgcttcacggatggaaaagacattcagttcccttgcaatagccattagcgtcagaagataatattcttcgtccatagctttatccgggataaattctttgtgtccttcgccgatccggtagtaaatgccgttgtattccagaatattcccggtgaagattggttcagtttcataggctttgatgccggttggggtgacggtgtttgctgttttcatattgccgtagccatgatctacagcaatgattttggtgtttctgagttctcgcataaaaaatacctccgttttcgtattgattgattcagcaggtcgtaccggtgtggtactgctctgctgtgggataagcatacgaaaatcggaggaaaaaggcattgaggggaaattgagcaggaattgagaaaaaagatatattgtgcttacgttcttcatgtactcttgttgtgatttcattgttttttatcgtataatatggatactggaggtggtttggatgaaatacaagattttagttgtcgatgatgataaagaattggtgaaaatgctttgtagttattttaatatgaaacaatatgaaaccattacggctacagatggaatggaagcattaaataaaataaaaatgaaaccggatattattttgttggatatcaatatgccacgcatggatgggattgaagtatgtcgtctgatacgcagtaaagtgttatgtccaattttatttctgacagcaagagttgacgaagatgataaaattaatgggttgctttcaggtggggatgattatattacgaaaccatttagtcttcgggagttggaagcaaggattgtcacaaacataaagagagaagaaaggcatcaacaaaaaacggaataccgtttcatggatgaaatgctgattgattattctgaaaaaatagtagctatagctggacacaggatggagttcacaaaaattgaatatcagattattgaattcttatccatgcatccagggcaggtgtttgataaagaacgtatatatgcacaagtctgtggatatgatgcggaaggggacagtagaacgataacggaattagtacggcgtataaggaaaaaaatagcggattattcagaaaaagaatacatagaaactgtatgggggattggataccgatggaaaaaataagaaacttgtcactgaaaaaaacaattctgctttattttgtgatcagcttaacggcagcatttctgttatctggatttacagttcattttgcaggaaatatgcagaataaaatatgggaaaaatatattgattatgcagattatacggacgtgtttcagcaatatggaaagaaatacgagattgagatatcaagacctaatcaatcgcagatgaatcgtttggactatcatctttcggaaatgtgtgactttatggaaacatattcggtactgattttttcgattgttgggagtgttgttgcggtattctttttttataaaaataagttaaagacacctctacaggaactaaaagatgcctcacaaatgattgcagataatgaactggattttcatgtgtcctatgaaaataaagatgagatgggaactttgtgtaaagaatttgaaatgatgcgaagtgctttagcagataacaacagaaagatgtggcgaatgattgatgacgagaaggctttgcggaatgcaattgcacatgatatacgttctccactttccatattgcgagggtatcaggaaatgctcttagagtttgtttctgctgagagtataaaaacagaggatgttattgatatcttacaaacaggcatgtatcagattgaccgtatagagcatttcacggaaaacatgagaaaaatgtcccatttagaacagagggaactgcaatgctcagagatagaattatcggaactggcaaaaaagattgaggcagaagctgccatgctgtccaagaaggaaagtaaattatgtaaggtagaaagagtgcaggaacaaaacattgtgaaagtggatgaggaacttgtcatggaagtggcagacaacttactggaaaatgaggttcgatatgcacaaaaaagtattgttttgcagataaagaaaaaggatggttttcttataatttctgttgaagatgatggaataggatttgtggatactgaggaaaaagtaacagaaccattttatcataagaatccacaagatgatttaaagcattttggccttggtatgtatatttctcgtattttctgtgaaaagcatggaggaaatttgaaaatatataatgccagacagggcggtgctcatgtagaagctcttttcaaagctgaataaaaatactttataaggctgaaatcacaaataaagtggttttagtcttttttattgtgaatttattgagaattgatttgtatgatgttgttaaagaaataaagaaaggaagagatacaatgaaaacaatcataaaaagaagtatacttgattatttaaagaaccctgttttgtggattggcttgattattatagttgccagtatgtatcaatgtctgtcatcgtatttgcaaattcattatatcaaacagaatgaacagatcacacaaaatgacgtagcattggaagatgctgatgtcatggatgggtacattcccacatctgatgataaagaaagaagaagggagtgggaagatacgatcaaagagacgttaatggacacctccaaaaatggttttggatttagcaggcaggaagcagatcatgtaatgaaagaaattcagaatatggatgtaaagactgcttctgagtttttggaatcccaatatggctattataatgcaatatatgcttatgaggaccttgaaattcataaggggacagcagaagaaatcaatcattatatcgagcggaaattatccgaacattctttttcctggtactttgccaaaaaatttacggattttgcaggattgcatatggccttttttgcaacagtcttgctatcatttttatttattcaggatacacgaaaaagtacctatgaattattacatacaaagcctgttacggcaatccaatatatatgtgggaaagtaataagcggattcattagtatgctgggagtattagtgattttgaatgttatattctttatgctgtgtttgaaaacgtctttagaatcgggctttccggtaacaccaattgatttttgcgtgaattctctgatctatattattccgaatcttttgatgatatgttgtgtctatacaattacagcattaatatttaaaaatccgcttccggcagcaccagttttgtttttacacattatatattcaaatatgctgaccatgaagaatgatatttattatatgagaccgttctctattatggtgcgattccctggcagattttttgaaacacatgtagccaaaatgtcaaacataaatcagattattcttgtaatttcatcagttatattagtatgtatttctgttacaatctggaaaaggaggagggttcattgaaaacggaactaaaaaactgcctgtcgttatataagattttttattcatgtgcatttatactgatattgtgtgctattcatccgattatatactatgaagaaatcggttcagcgattcagtctccgatagcatttttaacaattattttttgtagtgacacatatttgatggaagtaaaaagtaagcgtgccgatgtatttcatttgtatgatcaaaaaaagcagttaaaagtaatatcacagagagtgtgcgttcaaatattatatttattaatactttcctgtgttggatatgttttgtttttctggcaaaaaccgggcagtgtaaacgaaggcgtttcgggcactcagatattccttttattttccattgcaatgttcggaaccatctggctttggagtatatgctctgtgattttgtgtacattgcttggaaatatgtgggcaggtataggatgtttatttggaattgtcattggacttatatcaaaagcgggaagttcatttttcggaaatctgggattgttttctttcagcttttgtgaacctactcaattaatgtccgagagttggatttatggaacgcttgtgtcttttatagtgggtctgcttttatttgcagtattaccaatggctttaaagaaaaggggatagattatgagtattagaataaatgatttaacagttagatttaaaaatggtgtagttgcagtaaataaggcatctcttgaaatacctaagggaatttacggacttttgggagagaatggtgctggaaaaaccactttgatgagggttcttacaactgttttaaaacaaacggaaggaatggtttcccttgatggaattctgtataacgagggaaattatgaaaaaatacagaaaaagattggttatcttccacaggaaatcgacttatatccgaatcttacggtgaaagaatgccttgtatatatgggtggactatcaggagtatccacaaatgacctcaaacaaagaattacctattatttggaaaagacttctcttacagagcatcagaataaaaaaatgcggcaattatctggtggtatgaagagacgtgtcggactcatacaggcacttcttaataatccggattttttgattattgatgaacctaccaccgggttagatccggaagaaagaatcaggatccgcaatcttttggttgatttttcaaaggatagaactgtgctgttttccactcatgtagtagaagatttagcagcaacctgtacacagcttgccattatgaaaaagggaagttttttatattctggaagcgtgagtgggttgctggaaaatgcaaagggctgtgtttggaattgtacggtacaaaatgcagaagaagcccgtttgttagaagccaattattctatatcatctaagcagtatgtagaaaatggaattcatatgaaagtattaagcaaaggaaagccaaatgagaattgtgtcctggataatgatatcactttggaagatgcatatatttatttgacgaatagttgaatataacggcgggcaagttgcccgccgtaaattatgcttattttgttaaaagaccggatagattttttccaatgcaaaatccaatctgtggatataactcctgaatttcctgatattttgcttcaatcatttctggttcatcagcccagatcttttcatatattttgaaagctcttttaaaatgtgttttggcttgcggaagattggcagtcatcagataaatggttccaagggtttcctgaactttggcataatccagacagtcatcggaatggtattccttgatgatgccggataatttttgcaattcagagattcctctttcgggttcctgctgttctgtcaggaacattgcataattggcaatctgaggtatgctgtcatttatatgaagcaggttaaattggtcaagcagtgagatacttttttccatgtgttctcttgcaagatcgggatgaccgttcatgcggtaaagtccaccgagattggcatgaaggttggaaacaaggcgagcattgtcagcagtgatattttctatctgggcaagtgcatccttttccagttttattgctttttctggcttgatttcaagagtagcctgaaaatccagtaacaatgcccggtcagaatcggtgccaatgttttttgtctttaacagccccgttagttcctgaatgattccattcatacctttgtggtagttatagttatccatgtatggaaatgcattttccagaaaaagcagatactttggtatatcatccttttcaatcaattctatgatatttccgattgtttgaaatagctttttgtaataagctacttccattccatgcattaaacatatgtgctgtaaagaatccagtaatatgtggcaacgagttacagatggttttgtctctgaaagggtgatttcctgaatcatcggatgcagagagatagtgcgacgttttgttgtttggacaaaaccagtctcaattaaatcgttgatctcatttagtgtgggcaattccagccatttggcaaatatacgggcagaaataccggtggaaggaagaaagcacatattacacatgatatcctgctgtttaagagataaagtgtataacgaaaacagcgtatggatatgactgtaataggtggctttgctgctttgtccatctttgattattttaattttatcttcgttatggaaagatgctttttccacctgaagtcttgttaataactggtctggagttgagattccattttccagaagttttgctgccagttccacggcaaaagtatgagagtgaacagtttcgatgatcttttcaactgttggccggtacgtgtctgcctctgaataaaatactgatgccagctggaagagagcgttcatatcctctatttcttttaatggcagagtacagtattcatccagtttgcttctggttgtaaacaaaatctgacagcgatattttaatactactgacagaaagctgtcctgtgtggcagtgacattaaaattatctatgataagcagagtatcagatttcagggaacgcagaaaacggttatgtctttgaaaccgttcctggtcagtgctttccggcggatcgtcaataaaatccatgtcagtaatatcctgatgaagattgccggtatattctacataaaggatattggtgtattgctttatgtaccgctttgcgtaggctttggcaagttcactttttccgattccagcaattccgcaaagaaaaatatgacggttttcctcaagcatggtatataattcttccagttctttatctcttccgataaaatgacggcatggtttcggaacctcactgtccataatataatccagcacaatgggggataaagctcctccggcgagtagcttctgatttttggtattacgtttgatgaattggcgttccatgccaaaagaaatcagttttgcaagaaacagcagtcttgaactggctggtttatataagggagtcagatttttctttttcgcatctgagatgctgtcatcctgaatgaataaagtgtaaatatcttgtatagccatattacagtcagacatcagtggaagaagattctggtggatggtatgggctaacttttcctgattggatggcttggaatagtaagcggatattttaggactgattttagcctgaccagtcatccagcggcaaaccagaccgttatccattgaaaaatcctgatttgccggatcatccataaaatcttcaaataattcgtataaaaaatcaggctgactcatttgattactttcgctgatatgattttttaagcaagtgctaatagaagaaaaatcgcatcgattcaatagaaattcccctttcgtagttaagattgagtatatctatcatagcacgaacatacattcgattcaagaaaatgcggatatttttaaagtgattgtgtcaatttacaatcaatttctattcaatgtggttttcaggcaggttctgtaaaataagctcagaacaaacaataacgggaggagcttatgcaacagaatattgaatttgagcggtgcattgattttctggtacggatgattgataagtacggcgaagaagtcctccgggagttggaggaagaaaaacagaataaggaagaaaaagaagcggcagtttcctgaaatacaaaatgtaaatcagactgtcgctttttcatgtacttttaaatcaaataaattttaaaagctgatgcagagtgtgtggctcattattctgagaaacggtaatacgagtatcaaatggcttgaaatgattctgcgtataaaagctcagaagaaattcattatcttcgcattcaagaaactccataacgccacctacggaatatttgagactggatatggtttccagtgcaaatcccagtagaatatttccaggaattcgtttttcctttggaagagaatagttctttcccaactgggcgatcaggtaagctgcggtagtataggattgtgtttcttcatccaaaatactgacacgggacagcttttttgccattgtcttgctgatatttgaagcacggacagagatgggttttactgtaagtgaaaaataaccaaccagtgaagcatcttcagcatcaaataccagataagtgatagattgatcttttttggtaaactcaatcgcattatgtaataaaaagtattccacatcgggatttttgggacaagaaaaatcggagagtaagtcgtaaagactttcctctccgatatatgtcggttcgtctttatccaaatatgcccgaatattaacggtaaaatatttatcagacatgttttttcttcctttttgacattaaagctaagatttcctgtgggttcgttaactgacgtccgggaagtgtctgctttggtgtgcggtcacggtcagcttcgtcaattgctgcgacaaaacgctttacgctatttggattggatacgacaaaattatgagtaatacttgaagtagccatactaacacctcctcttttttggcttttttgtgtatttatagtatatgcaatgtgtgataaaaacacaatatcaaaaacagaaattatttctaaataattttcaagccggacatttattagacgcttccggtaggcgaacaatattttcgagccaatcatttataagtcgccaatggtgggcgggcaatattttgataacagaaatgctctgtatctaacttaattatacgattggcgaagaaatgcgtcaatacggaaaataagtattgaaaatagttggaacaagtactaaaattaagttgggacattgaatggaagttatgttacgagataataagaattgtaggtggaaggtttgaacatagaagcatatgatgctgattcattgagaaaaatggttaggttgcttgaatatgagaacaagatattaaaagataaattgaagaaagcaggcattttatatgaagaggtgaatccttttgaagaaaaaatagaaagtgcagaagaatatgacctggatcaagggagtcgtattgtaaatccgccatatattacagagaaaatggcaatacgtttcttttcgatgttttggggaagagaagatgtatatgccagacggggaaagaacgggggttattttccacaatgtgcaaatcgttggaatgaccggctttgtcctaaacaacgtaaagagaaggtattttgtgatgaatgtgaaaataccaaatggataagtctggatgtaaaaaaaataattgctcatttgttaggcacaaaagaagatggatcagatgtaataggtgtatatcctttactgccaaatggaacatgcagatttattgtatttgattttgataatcacgaaaaaggagcagaggttacggactttgcaaatacggataatgagtggcataaagaagtggatgcgcttagaaaaatgtgtgagcttaatggtatcagacctttagttgagagatctcgatctggaaaaggtgcccatgtatggattttctttaaaaaggcaatacctgcggcaacagcaaggaattttggatttctcctgttagacaagggttcaacttccatcaatctgaaatcttttcattattatgatagaatgtatccttcgcaggatgtggcaagcagcataggtaatttgattgcattgccattacaggggcaggcacttaaaaatggaaatagtgcttttgtagatgaaaattggaatgcatatcctgatcaatgggatgctcttttcaataaaacaaaaaagctgggaatagaagatgttgaacaatgcatggcaaaatggcagggagaattagcagaagtcagaggaacgcttactaatattgagaagaatgtcagaccgaaaccatggaagaagaaatgtgagttttgtaagtcagatgttgtgggcaagcttcatatggtattgggcaatggagtttatattgatactctgaatcttatgccaagaatacaaaatcaggtccgtagtttggcggcatttgataatccggaattttacaaaaataaaaggctgggatattctaattattataatttcagtgctgtatatttaggtaaggatatagatggatatatacagattccgagaggactgcgggaaaatattatacaggaatgtgaaaaagcaggcatttcagttgatgtttcagatcaaagagaaacaggacaacctatcagagtatcttttaaaggtgatttgcgaatgcaacaggaattagcagcagaaaaattattatcacattcagatggggttttgagtgcggcaactgcatttggaaagactgtagtatgtagttaccttattgcagagcgaaaagtaaatacgctcattttgctgcaaagtaaagatttgcttaatcagtgggttgatgaattgaatcatttcttagagataagagaagaaccaccggaatatgaaacaaaaacaggaagaaagaaaaaaagaaatagtgtgataggcgttttgcacggaaataaaaatacattgacagggattatagatgttgcaatggttggttcaatgtacagcagaggaaaatttaatgaacggattaattcttacggaatggtaattatggatgaatgtcatcacgcagcttctaacacatctatggaattattgcagaaaataaatgcaaaatacgtatatggtgtttctgctacacctaaacgtggtgacagtcttgatcggatcatctatatgctgttaggacctttgagacatagatttactgcattggagagggctaaggaacaggggattggacattattttgtcccaagatacacaagagtagttgatactgcagaaagcaaggataatattaataaagcatataatttgattagtaccagtaaggtgcgcaatgaaatgatcatagatgatgttataacttgtgttgcaagaaaacaaactcctgtaattttgacaagatttaaggaacatgcaaaatttttacatgatgccttaaaggaaaaagcagatcatgtattccttctgtatggggataattcggataaggaaaatgctgaaataagagtaaaattaaagcagatacctgaaaatgaatcgcttattttggtggcaactggtcagaaaataggagaagggtttgatttcccaagactggatgtattaatgcttgcagcacctgtatcttttgaaggacgcctggaacagtatgtaggtagattaaacagagattatgtcggaaaagaagccgtttatgtgtatgattatatcgattcgcatgtgcgttattttgataaaatgtatgcaaaaagattgagaacatataggaaaatgggattttcaatctggacgcaagagttgcaacctaaacaaataataaatgcaatatttgattctgtaaattataccgaaaaattcgagcaagatattgtagagtcagaaaaaatggcggtaatttccagtccggatatcagacaggataaaattgacagatttttattactagtcaagaagagacaggaagtaggggtaaaggtcacagttattacaacagatccggaagatattacttacggaaagtcagatgtatgttatgaattaatcagagcaatgcaattggtaggaataaatgtgataacaagaacagaagtagaagaatgttttgccgttattgatgatgaaatagtatggcatggcgggatgaatctacttggaaaagctgatgtctgggataacttaatgcgtatcagaaattcacaagttgcaacggaattgttggaaattgctttgggatgttctgaggagaggaggaaaagtgaataaaaagataaaatgtgatatctataccagagtatccacaaccatgcaggtagatggctacagtctggatgctcagaaagaaaaactcaagagatatgcggaatttcagaacatggaaatcgtaaatgagtattccgatgaaggtaaatctggaaagagcgtagagggcagaccggaatttcagagaatgttggataatattgagaatggaacagatgaggtgcagtttgtactggtgttcaagctttccagatttggtcgtaatgcggcagatgttttaaattctttgcagaggatgcaggattttggagtgaatctgatctgtgtagaagatggaattgacagctcaaaagatagtggaaagctgatgatttctgttctgtctgcggtggcagagatcgaacgagagaatatccttgttcagacaatggaaggacgtaagcagaaagccagggaaggaaaatggaatggtggatttgctccgtatggttatgaattagtaaatggagaattgcagattgcagaggacgaagcagagattattcgtctgatctatgacaaatttattcataccaatatgggaatctctgcgattgctgcatggctgaaccagcatggatacaaaaagaaaaaacgacagaataatacactggacgcatttgccgcttcatttataaagggcgttctggataatccggtatactgtggaaagctggcttatggacgaaggaaaaacgagaaagtttctggtacaagaaatgaataccgcattgtaaagcaggaaaattatatgctgcacgatggtatccatgaagggattgtttcagaaacagactgggagctggcacatcaaaaacgggaaaaaacaggtgtgaaatatgaaaagacacatagtctggatcatgagcatattttatccggaatattgagatgtccgttatgtggaagcgatatgtatggaaacgtgaaccgaaagaaaaagaaagacggaaccttatataaggattatttctattatgcctgcaaacatcgtcgcctggtagatggtcataaatgtggatatcgtaaacaatggagcgaggagaagattaacaatgcagtggaagaaattattcggaagctggtgaagaatccgaaatttgaagaagcaattctgaataaaatcggttcaagaatagatacagaagaaatagaaaaagagattgaaagactggaaaaacagcacaggcagctgactggagcaaaagcaagacttggacagcagatggacagcctggacatcatggataaattttataaaaagaaatatcaggatatggagacaaggttataccgtttgtatgatgagattgaagacgtggagaacagtatagaagaagtcaagaaccgcctgttgaatatccggcaacagaaaatatcagaagaaaacgtctatcaatttcttttatattttgataaactatatgataagttcaccgacctggagaagaaagaatttcttaacagttttgtagaacaggtggacatttacgagcaggagcagccagatggcagattcctgaagcacataaagttccgttttccggtgtattttggaggcagggaaacacaggaactttgttgggacaacgaaagtaccgttgagactgtggtgttgctacaaaggaaaaatatgtagaaatccttgaatttacgcactttgtggagtttttcagtttcagaaaaataggtgaaaatcacaaagaaaagagccttgtgaagaaagtaaccgttgttgttgcgttagacctcgagacggggaacacaaagaatcttgaatatgaaaatgaatagagagctatcagattattgatagattatagggatacttgtcaaaagcgggtgtccctattttttatagggcattccagaaatggagtgtcttttttataccaaaatattaaaaattcaggaggaaaacgaaaatgacaaacacagcgttaagagcagagaatagcaattctcgcacaattactttcaagagtagggaacacgaaaaattttatgaggaatatctgaaaaaatgcagatatcaggatgtctaccatcgggctttgatttattgcctgggtatcgacagagacacaagagataatgtgaataaaatctataattttaaaactggatgtgtaaaaacggaatgcctgcaggaagggtggcagaccagtggaagtttacgaattgtccgtatggcatttaacctgtattgtaatggaacaccaagcgtcggagattacgaagcagaagaagatcagttgaaagaatgtcagtgttataccgtagaggatctgttttgctgtggatatgcccggtatttctgggaagctattaaaatccgttatccagagtattgcttttacaaagactgggaggatatatatgctgaaaattagattacagggtactttgagggacattcaatggtttcgacgtattttggaaaatcataaggaattggatgtcctggaagtatctgatgcttatgcaaataaaggaacaagtaaatattttcgtgtttatgtagaagtagaagaaaaacagtaaatcggaggaaggtatatgtgtaaagtaattgctattgcaaatcagaagggcggagtagccaaaacaacgacaaccatcaatctgggagccggactgacaaagaatgggaaaaaagtagtgctggtagatgcagatccgcagggacatctgacaatgggaatgggatttcccaaaaatctcaaagtgactttaaagagtatgatggaaaatatcatcatgggactggagtttgatccaaaggaagcagtcttgcaccatgaagaagggatggatctgattccgtccaataaattgcttgccggaatggatatgtccttatttactgttgaggatagggaaaaagtactgaaagagtatctggaactattgaaagatgaatatgattatattctgattgactgtatgccatcattgggaatgttgacaatcaatgcgttgagtgcagcggacagcgttctgattccggtacagccacaatattatgcggcggatggacttatggaattactgaaagtggtaaaaggaatccatcagaggtttaatccggaattgcagatagaaggtattttgttcacaatggataattgccgttacaataatgcaaagagaaacaaacaggcaattaaaactacatatggaaatgacattaagatttttgagcagacgattccgagaacggaaagtcttgcagaaacagcatctgaaggtgtaagtatatttgcttatgatggaaaaagcaaaggggcagacagttacagagaactggttcaggaggtgttgaaacatgcgtagaccgaaaaaagagattcagcttacctcttatgatgagttactgggattagaagaatcaccggaaaagagtatgaaccaggttgtggaaatagaactggaaaagctctatcctttcaaaaatcatccatttcatgtaagcgatgatgaaaaaatggctgagacagtagagagtattaaaaactacggtgttttaaatcctgctctggtaagaccccgatcagaaggtggatatgaactgatttcaggtcacaggagaaaaagaggctgtgaactgtgtggcaaaacaactatgccggtccttgtccgaaactatacagatgatgaagctgtcataattatggtcgattccaacattcagcgtgaaaatattctgccaagtgaaaaggcccatgcctataagatgaaatatgatgctatgaagcaccagggaagtaaaggtgaaaaatatacggcagatatggttggtgaaacagccggggacagtggaagaactgtgcagagatatatccgtctggcttcattatcagatggattattggaatatgtggacgataataaaatccctatgatagtgggagaaaaattgtcttatctgaaaccacaggaacaggaatggcttctggaaggaattgtcaacagtaatatctttccgacaaaacaacaggcagaacaattaaaggaatgcagtgcaaatggaaaattaaatcagggttatatctatgccgttttattgaaaaaagaaaacagtaaaatcaatgtaaccattccggcaaaaagaatcggcaattattttccagagacatattctaaagaacagatagaagaagttatttttatgcttttggataaatggaaacaaaacagagaaggagtagcagatgcagaagatacagtttgattattttacgggaatggaagcggaacaatatagcttttatcgtgtcccgaaagtgctgtttacagaaccatgctttaaagctctttcttgtgaagcaaaggtattatacggtctgatgctggaccgtatgagcctgagcattaagaaccgatggctggattcagaggacagagtatatattattttcacggtggaagaaattgcagagctgatgaactgtggaacccaaaaggcagtgaagctggtaaaagagttggacagtaataatgggattggactgattgaaaagaaacgtctgggtctgggaaagcctaatgttatttatgtgaaaaattttatgctcagagaagtgccagaccaaaagccgatggatagctgtgcagatttgcaatcagagcagaaaaattatagaaaatgtgcagatctgcaatctgagcagggaaaccatgaagagtgtgcaaatctgcaatcagaagctgagaatagggaaaaaacaggcacttttctgaattgtgaaaatcatcattcaggagtagtgaaatccacaattcaggattgtgtggaatcacaattacagaatggtgaaaatcacaattcaggaatgatgaaaaccacaaatcaagaatttccagaatcacaattccaaaattgtgaaaatcatcattcaagaatagtggaaatcacaaaaccagaatatccgaaatcacaatctaataatactgatattaacaagactgatattagtgaaactgagataaatcaatcctatccaatcatatcaggcaatctgaaaaagaaaagagatgtgatggaggagatgcgggcatatcgtgaagtgattcatgaaaacatagattatcaatatcatgccaaagaagatgtggatgaactggtagaactgatgattgaagttatgatgatgccggaggacagtatgattcggatcgcagggacagaaaagccagttgctttggtgaaaagcaggtttatgaagctgaattattcacatatcgaatatgtgctgttttgtctgaatcgaaatacgaccaaggttggaaacattaaagcatatcttttgactgccctgtataatgccccggcaacgataaacagctattatcaggcagaggttaatcacgatatgtatggaggataaaggaacatgagaaatatgataaaaaaagttattgttccagcactggtgattgttgtattgtttgcagtgctgagaccgctttgtatccaggatgggaagtgcaattatttattgctgttgctactgatggggataccattcggaattggaaaaatgtgtgtctggatggttccaagagggtttgaccttggaggaacactggcagtatggataatgaattttctgatcggaggattgataggaagtgtcgttcttctggcaatggttggacaggcaatcatttatcttagtgttttcttgctcacagttattacaggaatacataaaataccgagaataaaatgaaatagatcttttgaaaagcagctaagacaaaattagctgctttttttctggaaactttgcgacacaatgtcgtaaagctgggataaattgcaggaaaggagacaccgtattgagcaatcgtgcaatttccacagaacttattgaattgggagaacggatcagaaaacgcaggcaggaaatgaagttgtcacaggaatcttttgcggaaaaagcaggtatcagtgtcaatacggtcagcaggatagaaggagggcaaacggcaatgtctgttgagattttcaggaagatgattgagatcctggaaacagatgccaatatcctgatgggaaaagagagggacgatgcagaaaaaagaaagcagtttgaggaagtattttatcgtattcagaagatggaatggaaagagcagaaaattatcatgcagacaatagattcactgatagaaagttttaatgagtacaggtgaaatttcaccatatatggggtgtaaaacaaaaaaactccccatatatgctaaggataatagttttttgtgctgttaaaatagcaaacagagagaaagagacagaaacaaggaagggagacaggattgatgaccagacaagaaaatttaatctatcggaagcagtgtccctatgatgcaatgggagactattctgttttgatggaaaatgaaaagaacataaaaacagaaagaaatgcaaagaagtctgaccgggacatcagacggaaaataaaatagaggctgctgtaaattagcagaaagggcagtaaggaagtttcaggctctcgttaaaaaaaacgggtgtgccggaagctgttttttactgcccttttgccagtagatcagtaataatcctatcctttctgctgatgggcacctgttgccagcaggcagaagggtggtaatcatgctgacattgcaggaattgaaacaggttgtaggtaacagggaagaaagaagaaaggttccatccgccaggtatttaagagaaaacgatgtggcagttgtaaagcatagactgatagatggtgcggaaattattgcgtatcagacaggatatgttttctattgtgcaggtgattatggaacggttttttctttatttacctgtcgagattatgtatatgaagcaggaagaaaaataatagttgttaaggaagatttttttgataatcagccctggtatgtgcggttgatattagaaggtgaagatcggctgtgcaggaacagggaggtacgagaacataataattgcatttcatatagccatatttcagaaggctggtgtgaattggtggacaaaaggcagaatgtacttgaaaaactgattatagaagaagttattggagaattcatggatctgctgactgaccggcagagacaggtgatccatcaaatttattttcagcaacggacacaaagagaagtgtcacgggtgtttggaattacagaaccggcagtatcaaaatgtatttcacaggcaaagcagaaaatgagaagaaatgcaggcagactgatcggagtgcttcagaagggagaataaaagatgcgtggtaaaaaaccaaaggaaagacaacggtatgtgctgcgtgtaaatgaaactctcgtagaagttaccagagacgtatatctggcatggtaccagtcaagaagaaaagaaagataccagcttgaaaaaatgcagaaaaatggtgtatgcggaatagaaaaagtaggagaaacgagttacaacagttatttgcatatattatcaccagaagaaatagtcatcagggtgtcagaaatacaagagctgcaggaagcactgaaatatttgtctgaagaagaaatggaattgataagactattattttttgaagagtacacagttaaaaaaacagcacagtatttcgggtgttgtacaaagacaatcagaaacaggaaaaacaaagtattgcagaaactaaaagacaggctggaaactttgtaaatttttgctgtttcaaaaaattttctaaaaaaatttcaaacaggttaatttttgccctttcacacatgcggttagtggaggggcaaatgtctattttaattcaaaacaataaattccctcctaaaagtgaaccttgacaatttcatatcagcagcaagaggatacctgaatttcccagctacgcatctggcggcgggtattcggtggcaacgtgaagggcaatggatgagaggcacccttggcaggaatgattacgaattacctcttgcggcttaatagctcaatcctgtttttatttaaaagtcaatccaagacacaagggaggtggtttatatgattgattcatgcaggtgtaagcctgaacgaaagtggagtaaattatcgaagaaagagaggactcagtcaaaatgaaaatgcgatttaaaagattcttgtcgggatttatggcagttgcaactttggcgtctgttatcgttcaaccagtcacggtttctgcttctgaattagaaccggagacaacttcatttgaacagcaatatccggaactgcagtatgtgcaggatactcttgatgaagatgaaattgtgaaagcaaaggatattgagattccctatggagaagaatttgaagtggaagtcgatctgtccggtatagagggcgtgaatgaaaaaaaggtgaaagttttattccatgaagcaaagagtgaagccggtacagattttgacgcacatacaccggatacctacaaagctgtctatgcagtagagccagtcagcggtcacccagcttacagagtaagcagaaacattacggtaaaagagccggaaacagaagcacagacaaagagttcttctgaaaatacagctggtgaaggaaatgccggtgaaacagaagattccggtaatgcggatgaagatgctgattcggacgggtcaaaagaaattgtaactgatcttacagatgagcaggaagtgacgacagatgaagaatccggtctggctgtttcagaagtaatggatcaggcagcggagaacggtatcgacctttattctatggaagaaggagaagcggttactttcatggcaacagacattgcaacacagagtaccaagaaagttacagtaacaagaggaacctgttatcagtattcggattacgggtatggaagttatctgacttacaaatatacggttcagtttggtaatgtttctgcaacagcatattgcgtggagccttctaaatccagtccgggaagtggtacttatgatattacaaagctcagtgatggtaagaagctggcaaaggtttgttactatggcacaaaggcttccggtgatgaaggatttttcacagaggaaaatggatatggaaacctaagtgcaggtgccagatttattctggtacatctggcagcatcttatgctaatggtggagattctgccttttccggtgcaagcggtacagcaaagacacttgcaatgaaactgtataattactgtatttcacagccggagattccagatgtagatatgagtttttctgatgcagatgtgacagcctatgtagatggcaacagccagagaacaaaggaaatcatttttaaagcagatgaactgcagagtatcacaatgaaacttccaagtggtgtgaaacttcacaacgtgacaaccggaaagacaagcaaagctggtgaagcagtggaaatcagtggtggaaccaagttttacttatctgcacctcttacacaggtacaggatgtcgcaggaagctggtcggcaacgatgaaaggcagtgtaacaaaagattattctgcatataagatcagtaccggatctggttcacaggacctggccctggtatttggtgaaggtgttgatgatgagaaatatgtggacttcaaagtaacctgggtgcagcacgcaagtgtgaaggtgattaaaaaagatgcaaaagcagacgcaaagctgtctggtgcagtgtttggtttatacagtgatgcaaactgtacaaagctgatcacaaagttaccggcaaccgatgcgaacggggaatcgtccgtacagatcattaagacacaggacactgtatatctgaaagagattacagctccgacaggataccgtatcaatgcaactgcctacaatgtaaaactggaagtcagcaaaacaacgactgtgactgttccggatgaagaacagatgggacagctgactgtttataaagaaggtcaggttctgacaggtgcagatgtcaccgagaatggaacaacatttaagtatgagaaacgcagacagaaaggtgcgatttatgatgtgtatgccggagcagatattaaaactgcttatggtgccaaggtttacagcaagggtgatctggtcaaagagaatctgacaacagactcgaatggggcagtcattctgaaaaacctgcatcttggtacatatatcatcaaagaaaaacaggctccgaccggattttataatgccggggaagaaaagtcagtcactctttcttatgcaggacagaatgtagatgttgttttttctgagacaacttttacgaatgacagacagaaagcagaagtagttgtgacaaagcaggataaggatacagaaaatcctctggatggaggaatttttggactttatgcagccagtgacattaaaaatgcagatggaacggttgttgtaaagaaaggcactctgattgagaaagtgacaactggaaatgatggaacggcgaagtttaccgcagatctgccgctgggattttcctatgatgtaaaggaagtacaggctccggaaggctatctgagaaatgcggatgatatctatacgtttactttttcttatacaaacgataaggaagcgaaactgacatttaagcataccttcaaaaacgagcgtgtgacagcaaagatttccttacagaagcaggacaaagaaacaaagaaggctgttccacagggagatgctactttagaaaaggcagtctatggactatatgcccgtgaggatattgtccatccggatggagcaactggtgtgatctacgaagcgggtgagcaggttgccactcttacaacagataagaatggacaggcttctgtagatggattatatcttggcaattactatgtaaaagagattactcctccaacgggttacctggcagatgaagaagaacatgatctggtctgcaactatgagggtgattttgtagcggaagtaaaacgtgactgtctgtctctggaacaggtaatgaagcagccatttgaaatcatcaaggcagcgaacaacggaaagacagatgccgatttactgaaaggtgcaggatttaccgcttatctggtatcttccctgacagtaaaagaagatggcagctatgactttggttctgccaagccggtagtgatcggggaaaatggtgcaacagagatctttacagatgagaaagggtatgcccgcagtattgcgattccgtatggaacttacatcgtccgtgaaacaaccacaccacataattacactccggtcaatgatttcatcgtacagattacagagaatcatccgactacaccgcaggtatggagggtgctgcttgacaaagagtttgaagcgaagctgaagattatcaaacaggacgatgagacaaagaaagcagtccttcagaaaaatacggagtttaagatttttaacctggatacagaaaagtatgtggagcaggtaacaacgtatccgacgacggtaaaacacaaatcttattttacagatgagcagggatacttaatccttccacagaatctgaagattggacattaccgtattgaggaagtgaacgcaccttatggatatacgctcaatgagaattactatgaggtagatgtagattccaatacagcatatcagatggacggaacttccggcgatgtgatcattgagatcgcatacgagaatcatccggttaagggagaactgaacatcgtaaaacagggtgaggtcttaaatggttataaagatgactttacttatcagaaagaaactctggagggagcagtctttgaggtatatgctgccgaagatatttatacagcagatttccagaaagatgataatggaaaccgtatcctggagtatgcttctggggaactggtaggaactgttaccacggataaggatggaaaggcacagatcgctgaccttccacttggaacctataagattgttgaaaagacagcaccagagggctttgtgttaaatgaagaagcacagacagtaacatttgaatacaaagaccagaaaacaccagttattgagcagacagcaacctttgagaatgaccgccagaaagtggaagtgtccgtagtcaaacaggatgcagagacaaaaacggttgtggcgggtgcagagtttggtatctatgcaaaagaagatattctggcacatgaagaagtgattgtgaaggcagataccttacttggaaaagcagtcagtggggaagatggaaaggcagtatttgacgttgaccttccatttagtacttactatatcaaagaacttgcagctccggcagggtatgtctcttcttttgagactttggaagtgactgccaaatatcagggacaggatgtgaaaatggtagagctggaatctgtatttaagaaccagccgacaaaagtaacctttacgaagtccgatattacgacaggcgtggaactttccggggcaacgcttacggtgcttgataaggatggaaatgtggtagatacatggaagtctgtaaagggtgaggaacacttgattgaaagactcacagcccgggagacatatactcttcgtgaagaaatggctccttatggctatctgatggcggaagaagtttcctttactgtggacgatactgctgaaatccagaaggtagagatgaaagatgcagtgccaaccggaacacttatcatcaataaaaaaggtgagttcctggagaaaatatctgcactggattccattggcggatggatgaagcatctgtttgaatatctttccggttccctgaaagacgttacttttgaggtttatgccttagaagatataaaagcggcggatggtgagagtgaagattactacaaaaaggatgcactgatagcaacgatcacgacggatgaaacaggagtggcgaaactgacagaccttcctcttggcaaatactgtgtcaaagagaaagagacagcaaatggatatgtcctggatggagaagctcgtgaagtggatctgacttaccgtgaccagaataccgcagttgttacttattctgctgactggcagaacaaacgccagagagcagaagtaaacgtgttaaagaaagaaaaagattccgaccgtgtactggaaggggctgtatttgccctgtgcaataaagaaaatattgtcaatgcaaagggcgatgtgatcttgaaagcggatacggttattgaggagcaggctacggataaggaaggaaaactgacctttacggcagatctgccacttggctatacctactatgtgaaagaaacttctccggcaccgggatttgcgacaacagaccaggtacaggaatttacttttgaatatggtggggcagataaggaaacactgtcttatgtgtttacttttgaagatgagccgacaaccgtagagtttaccaaaacatccctgacagacggaaaggagattgagggagcaaaactgaaagttacagatgagagtggaaacactgtggatgaatggacttctggtaaagaaccacatatcatcaaagaactgaccgctggcaagaagtacaccatgacagaaacacttcctgcggacggttatgtgacagcagagagcatcacttttacggtggaagataccggtgaagtacagaaggtggaaatgaaggatgatgtgacaaaagtgcagatttccaagaccgatatttccggtaaggagctgccaggagcgaaactgacgatccttgataaagatggaaagaccgtagaaagctggacatctgagaaaaaaccacactatattgagatgcttccaatcggggaatatatcctccgtgaagaaactgcaccggatggttatctggttgcagaagatgtgaagtttacggtcaaagatactggagaaatccagaaggttgtgatgaaggatgaggcgaaaccagaggaaactccaacagagacaccgacggaaacaccagaaaccacaccaacaccggagacaaaaaccacagaagaaacaaagaaatcgacttcaccaaagacaggagataatacaccgattctgttctggattctgcttgcaggggctggaatggctggtcttggtggaacagtgattcttcgcaaaaagaagaaataagagatcataagatttcttagtaatggatgagggcatttatggacacaggattcatagatgcccttttataaaatttcaaaagaattagggagaaaagaagatgacaaaaacagtattgatcgttgctgcagctgcagtatttctggtatatggatttgtcctttggtgctgtatcaaagtgggggcagaatcagaaaaagaatatatgaaactggcagaaaagagaggaaaggagtagcaatgtgataaatgaggataagacagcagtgaaagaagaaagggcgtggtgtgattgcaggatgaagtgaatgagaaaacagtctcactttgtatccgctgcggcaaggtcactgccaacttgctgaaagctgccatggtaaaggctcttgcaaagatggagcaggagaaaaaacagcagggacagaaacagccccagaaggaaaaggaggataagacctataagggaaaacagagtcttgataagctgatgaagcagaatgtacagctgtccaacattgagatcacagatggaaacatcaagtcttttgaacgggtagcaaaaaagtacagcattgatttcagtctgaaaaaagatgtgactgctgacccgccaagatattatgtgttctttaaggcaagagatgccgatgtgatgactgccgcttttaaggaatatacaggacagacgttgaataaggacaaaaaaccatctgtgaggaagaagttacagcaggcaatcaccaaatcgcttgcaaagcacagagaactggagaaaacaaaaggaaaggagaaggagccgtcattatgagcagattacagaaattgcttggtgtaggaaaaggatacctggagaggttaccgccggtggatgtacataagctgcttcggattgttctgatgaatcttccgtatatcgtgatcttttatgtgggaaataagctggcatggttatatcaatactgtgtgggtgattccatgatagaaagactgatggtactggtcttaaatttccagatggcattcagcaggattcttccaagtatgcataaaaatgaattgctggttgggattacaggagccgtggcggtgaagctcttggtctatatgaaagggaaaaatgccaaaaagttccggcagggagtggagtatggttcggcaagatgggggacggcaaaagacattgcaccctttatcgacccggtatttgagaacaatatcctgctgaccatgacggaacggctgaccatgaatggcagaccaaagaatccgaaatttgcgaggaacaagaacgtgattgtgattggcggatctggctcaggaaagacacgtttttatgtaaaacccaacttgatgcagatgggaaaatacatcagttatgtggtcacggacccgaaagggacgatcatcattgagtgcggaaagatgctggtacggcatggatataaagtgaaagtattgaatacgattaatttttccaagagtatgcactataaccccttccactatatccattcagaaaaggatattttgaaactggtaaatacgattatggtgaacacgaaaggggaaggcgagaagtccagtgaggatttctggacgagtgcgactcgttcgcagacggtaaaaagtctgcgcacgagcaacggttttccgttgttcggagaactggtagtttgataggtggaatgacggggtaacgccctgaaacgcctacccttgatgggcgtgcattagctgtaatggctggtgtacgaagccccatgacaaaggctgagagtaaccgtaaccactgcctaaagtggtcgaaagcggtctggaggcagactgtgttacctataagccgagagtctataagatacctatggttagaatgttcgctttggcgggcggactgacgaacctgcgaatgtacaggtctaaaagaagaccacgcagaaatgtgtgggtgcgttaatgcgcagtcggtgtggtttagtagaaattgatcctacgaacgaccatgctgtgttacaggcacaggcaagccgacaggtctatagcaggaacctacgggtatgtatgaacagatagaactatcggaacgaggaaaggcagcagattccgcaaggaatagtctgacgaaaaacaataagcagacgaactgctgctgaaaagtagtggtcgaacctatgatgtgcttgcgttatgtgagctacggaggaatggccacaagtcgattgagataagcaggcattattcaatccaacataaggattcgagtaagaccaaaagggtcactttcgcaaaaaggaggtgatgccttatgccaaagaaaaacaaaactctatgtgtagatgacttacgtcatgccgagtattacggtatgcagccagtttttgatgaactctatcatcgaagtttggagggagaaaattttaccgaccttatggatttaattctgagccgggacaacattcttctggcatatcggaacatcaaagcaaacggaggaagctacacagcaggaacagacaacaaaaacatcagtgacatcgggtgtttaccgcccgaaacagttgcagagaaagtgaggtttattgtcacaggaagtcagcacggataccgcccaaagccggtaagacgcaaagacattccgaaaccaaacggaaaaaccagaccgttaggtattccctgtatctgggacaggctggtacagcaatgtatcaaacaggtcatagagccaatctgcgaagcgaaattcagcgacaacagttacggctttcgcccgaaccgttccgtggaacacgccgtgcagaaaacttacaccatgcttcaacgcatgaacctgcattatgtgattgagtttgatataaaaggatttttcgacaacgtaaatcacagcaagctaatgcggcaaatatgggcaatgggaatacacgacaagcagttgatttttattatcaagcggattctgaaagcaccgattagaatgccagacggcactacactcattccagacaaaggcactccgcaaggcggtatcatttcaccgttgcttgccaatatcgtgctgaatgaactggacaaatgggttgagagccaatggcagaaccaccctcttgtaaaggaatacgggtatgagaggaaaatcagaaactcgattacttttgaccggagcaaggcattcctcaaaatgaggaaaacagggttgaaagaaatgtatatcgtgagatatgcagatgatttcagaattttctgccggaataaagaggacgctttgagaacgaaagaggctgtaacggcatggataaccgagaggctgaggttggaggtatcgccagagaaaacaaggatagtcaatgttagaaaacgctattcagagtttcttgggtttaagatacgagtcagaccgaaaaacaggaagtacatcgtgcaatctcatatctgtgacaaaaagttggaactggaaaggcaaaaactggtggaacaggcgaaacgaattgcccgaccttcagagggaaaaagacctttggacgaaatacggctgtacaattcaatggttctgggaatacagaattattttcaacttgccacctgcatcagcattgattgcaggaaaatccacagacaggtcatgacagttttaacaaatcggctcaatacagaaaccgggtgcagacttgttcgagagggcggcgcaatgaccgagagcgaaaaagaacggtttggaaagtcggcaatgatacggtatgtatctggaatcgaccaacctatctaccctatcgcatacatcaagaacaagataccgatggcaaagaaagcggcggtttgcagttacacggtagagggacgggcattgatacacacgaacctaagtatgaactcatctgttctatcaggtttgaggaatcaaccgtctatggggcgaagcacagaacttactgacagcaggatttcactattctcggctcaacgtggaaaatgtgcgctaagtggggaactctttgaaaatgcggctgacatagtatgctggctgaaaacaccggcagaattgggcggcaaggaacgctatcgaaatatgattttgttccataatagatttcttccactcctgcaagagtgtcctaagaatgagctaaaagagatagccgacacgctcaaggcaacaaaggaactgatgttaaaagtgaacagtctgcgccagcaggctggtttgtccgcaatagaaaactaacatttcatttggtgattgattaaatgcttgtgaaaacaaccgatggaacgccggatgcggtgaaagtcgcacgtccggtgtggagtgggggaaaatccggcgataacttcaaaggattacctatcactataagcagagaggcttctgtactgtgccctgatcggctatatctggtatgaagcaccggaagaagaacagaactttgcgaccctgcttgagtttatcaacgcttcggaaacaagggaagatgatgagacatttaaaaatgcagtagatatgctgtttgaggaactggaaaaggaagaaccggagcattttgcagtacgtcagtataagaaatataaactggcggcaggaaaaacagcaaagagtattttgatttcctgtggtgcaaggcttgcaccgtttgacattgcagagcttcgtgagatcatgagctatgatgagatggaactggatatggtaggtgaccagaggacagcactgtttattatcatttctgatacggatgatacttttaactttgttgtggcgatgatgtacagccagttattcaacctgttatgtgacagagcggacgatgtacatcatggaagattgccatatcatgtcagaatcctctgtgacgagttcgcaaatatcggtcagattccaaagtttgacaagctgattgccaccattcgtagcagggaaatctctgcatccattatcctccagtcgcagtcccagttaaagacaatctacaaagatgcagctgaaacaatcttaggcaactgcgacacgatgttattccttggcggtaaggaaagttcgaccttaaaggagatttccgagacgctgggaaaagaaacgattgatttatataacacttcggacacccgtggacagagccgttcttacgggatgaactatcaaaaaacaggaaaggaattgatgagccgggacgaacttgcggtcatggatggcagcaaatgtatcttgcagcttcgaggtgtaagaccatttttcagtgacaagttcgatattaccaaacacaaacggtataaggagctgtcagactacgataagaaaaatgagtttgatgtggaagcgtatatgcggcatcggatggaagtgaaactgacgaggacacaggaatttgacctgtatgagttttcggaagagagtctggcaggagaattaaatacagaaaacaaggaagcagagcatgtgaaagattcggacacatagctcttttttctttgcccttttgggaggtgatggatttgagagatcatgaaaggccacccgtaagggcagagccggaaaagacttcttaaagatagaaaccagagaaatacagagatttgaaaggagacaacgaatatggcgttttttaatcaggcaatcaatattttgcagacacttgtggtggcgattggagccggacttgcagtatggggtgttattaacctgttagaaggatatggaaacgacaacccaggtgcaaagtcccagggaatcaagcagtttatggctaattaaagggaacaaaaagaaaggaaaagcacaatccagacggtatcagcggcaggatacaagaataaattgtgattacacaagattggtgttataataagagaaaagttcctgccggggcagccgccccggtggtatggataaaaaggcaggaaaacaatatgcacatcagctataaaccactctggcatacactgttagagcgtgatatgagaaaagaagatttaaggcttgccgccggtatgacaacgaatatgattgccaacatgagcaaagagggaaagcacatcagcatggatacattggcccgtatctgcgaaacgctgaattgtgagattaccgatgtgattgagttagtaccagacgagcctgcttccacaggaggtaaggaacatgagcgaattgaaaccaagaataacggaaaacggaattgattatatccttgtcggagattactatatcccagatttgaagctgccggaggaacaccgccctatcggaaagtacggacggatgcaccgggaatatttaagagaagcccacccagccagattgaacacattgacactgaccggggagttatggacatatcttgcagacctgaacgaacaggcacaggaacggttagacaccatcatggagcagatgaaggctgccgatggtgtgaccgaggaattgaagcgtacccatcaaatggaatgggtgcagcgttgcaataacattcacaaccgggcagaagaaattattttgcaagagatgatttattcataacggtatggtagaatgattatgacaaatcgaaagttgacaaggagttttgatagcgtgaaaaaaagataaagtccgtataattgtgtaaaagtaaaaaggccatataacagtccttttacggtacaatgtttttaacgacaaaaacatacccaggaggacttttacatgacccaagtacattttacactgaaaagcgaagagattcaaagcattattgaatattctgtaaaggatgacgtttctaaaaatattttaacaacggtatttaatcaactaatggaaaatcaacgaacagaatatattcaagcaaaagaatatgaacgaacagaaaaccgacaaagtcaacgaaatggctattatgagcgcagctttacgacacgtgtaggcacgctagaattaaaagtacccagaacacgtgatggccatttttcacccacagtgtttgaacgttatcaacgaaacgaaaaagccctcatggcttcaatgttggaaatgtatgtatcaggcgtttcaactcgtaaagtatcaaaaattgtggaagaactttgtggtaaatccgtctctaagtccttcgtttctagcttaacagaacagctagaacctatggttaacgagtggcagaatcgtttattatcagaaaaaaattatccttacttaatgaccgatgtactctatataaaagtacgagaagaaaatcgagtactctcaaaaagctgtcatatagcgattggaataaccaaagatggcgaccgtgaaattatcggcttcatgattcaaagtggcgaaagcgaagagacctggacaacattttttgaatacctaaaagaacgcggtttacaaggtacggaactcgttatttctgatgcgcacaaaggattagtctctgccattagaaaatccttcaccaacgtaagttggcaaagatgccaagttcacttcctaagaaatatctttaccaccattcctaaaaaaaattcaaaatctttcagagaagctgttaaaggaatttttaagttcacagatattaacttagcgcgtgaggctaaaaatcgattgattcatgattatatcgatcaaccaaaatattcaaaagcttgcgcatcattggatgatggattcgaagacgcctttcaatataccgtacaaggaaattcccacaatcgactaaagagtaccaatctaattgaacgactgaatcaagaagtacgcagaagagaaaagattattcgcatcttccccaatcaaacatcagccaatcgcttaattggagccgttcttatggacctacatgatgaatggatttattcttcaagaaaatacatcaattttgataagtagaaatggtaaaaacattgtatagcattttacacaggagtctggacttgactgagtttttaattgatgataatatggtttttgatattgataatttaaaaggatttcttaatgataccagttcatttgggtttatagctaaagaaaataataaaattataggatttgcatattgctatacacttttaagacctgatggaaaaacaatgttttatttacactcaataggaatgttacctaactatcaagacaaaggttatggttcaaaattattatcttttattaaggaatattctaaagagattggttgttctgaaatgtttttaataactgataaaggtaatcctagagcttgccatgtatatgaaaaattaggtggtaaaaatgattataaagatgaaatagtatatgtatatgattatgaaaaaggtgataaataaatgaatatagttgaaaatgaaatatgtataagaactttaatagatgatgattttcctttgatgttaaaatggttaactgatgaaagagtattagaattttatggtggtagagataaaaaatatacattagaatcattaaaaaaacattatacagagccttgggaagatgaagtttttagagtaattattgaatataacaatgttcctattggatatggacaaatatataaaatgtatgatgagttatatactgattatcattatccaaaaactgatgagatagtctatggtatggatcaatttataggagagccaaattattggagtaaaggaattggtacaagatatattaaattgatttttgaatttttgaaaaaagaaagaaatgctaatgcagttattttagaccctcataaaaataatccaagagcaataagggcataccaaaaatctggttttagaattattgaagatttgccagaacatgaattacacgagggcaaaaaagaagattgttatttaatggaatatagatatgatgataatgccacaaatgttaaggcaatgaaatatttaattgagcattactttgataatttcaaagtagatagtattgaaataatcggtagtggttatgatagtgtggcatatttagttaataatgaatacatttttaaaacaaaatttagtactaataagaaaaaaggttatgcaaaagaaaaagcaatatataattttttaaatacaaatttagaaactaatgtaaaaattcctaatattgaatattcgtatattagtgatgaattatctatactaggttataaagaaattaaaggaacttttttaacaccagaaatttattctactatgtcagaagaagaacaaaatttgttaaaacgagatattgccagttttttaagacaaatgcacggtttagattatacagatattagtgaatgtactattgataataaacaaaatgtattagaagagtatatattgttgcgtgaaactatttataatgatttaactgatatagaaaaagattatatagaaagttttatggaaagactaaatgcaacaacagtttttgagggtaaaaagtgtttatgccataatgattttagttgtaatcatctattgttagatggcaataatagattaactggaataattgattttggagattctggaattatagatgaatattgtgattttatatacttacttgaagatagtgaagaagaaataggaacaaattttggagaagatatattaagaatgtatggaaatatagatattgagaaagcaaaagaatatcaagatatagttgaagaatattatcctattgaaactattgtttatggaattaaaaatattaaacaggaatttatcgaaaatggtagaaaagaaatttataaaaggacttataaagattgattatataatatatgaaaagctattataaaagacattagtattaaatagtttaaaaaaatgaaaaataataaaggaaaaaaatatttcttaaaattgtgataggggttgttcttgcttgtattttatttgtttgttttctttatacgaacaatgagatcggcgtgacttcatctaagctggaggcagatattcgttcgtcgcagaagattaaggatgattggacggtcgatggaagcgtttccagcacgatggctgcatatatttcttaccctcaggatttgagtgaccattctttttccgtctatgtcaatcgtccaggactttccttcggatattttttccgtggaggtggaactctttcggggattcaaagaggaattgtggagtttactgtagagggatataatgaacgagcatttatttctatgaatcaacagcaggtgcaacaacttgaaatagatgatggcaacacaattcaagtggttgatattgaccgcaataaaccttttgcgattgtcttgcctataaatgcgggtaatattactttttatgatgtaaatagaaatactgtggaatattggaataatcctctttgacaaattccagtttgtcgtgctaaaaattcaactgaataatcccagcaaaaaccgctgctacatggaagccaacaaaccatgcaacagcggtttttctttatcgttttttcctctggctgataggcgttcccattttctttgattttttgagaatccgaatcagccagcgaaattcttcatctgacagatttttatagttgataccaagctgcttacagtaaaggacaaccagcttttcatcacggctgcccttgaaattttcaaccgcttccagattttctttcagttcatcggcaacggtggtctgaggtgcactctcgctgtcctttttatgggcttcccgaatatcccggataatcaggttgaggtcatcccgtaccatgtgactgaaatattcatcatcactgatatgggcggcttgcaacactttcaaatgggggtcatcttcgccggggcgataccgttcaatgatttcatgccggacggtatcgacaagggcgttgaggttttgaatctgcatggtggcaatcccatccacataaatctcaatgtccgcaagaaacttgataaagtccttatgggtggcaagttcgcacagcagacggttgttaatccgaccgcttttcagaagtgctaccatctcatcactcaaatgcagctcccttaatggcgtgttgatctccgcccggttctctgtccggcaaaagagataatcgagggacaccccataaaaatctgccagcaggataaggttgccatgattgatttccttatagtcgtctttttcataactgccaagagccgattttgaaatacccgtttgctcagccagttcttccagttttaatcctttgtttaatcgtaaatcttttagccgttcctgtattgtagtagctccgttcattgaagcagttccccctttctaacgacatttataaccgttgaattgattataccatatcaattccgcaatcgtggaaatttctgatttttaccccgaattcctactttgtggacatacggcacagggcacaaaaatgttctatgatacaggtagttcatcgatggattattccaatcgaatgaccagcctgtgtgggatatgcttccccggcgatgtagcgtcatgacttttggcagggatatggaggaaccctgaccaaaacgagcgtaccaaagggagcgatacgccgctgtgagattcaggggaggaacgacaccggggagaactggcgaactgacaccgaaatgataccgaaacacaacaatctgatagggggacagtctaccctatcgctgatacttcgggagattttaagcggctctatggctgtaattttaccgaaaatcgccccgaaaccatacactaaaacgggaggaagcgcaatatgccgagaatgagcaaaaagaggaagcatgagctttctttttacctcaatgaccgggggcgtgtcacttacaacgaattatgccggaaatgccagcatgggtgcaggcagagcttccgggcggttgtgattgactgcccccgttatttatccaaacgagccaagaaaaaggaggaacacaccgaatgaattttgaatttatgacgatagacacaccattgccgccctgtatgccttttcccagagcgttgacaggatttccagtcagcagcaccgcaaaggtcatgtactgccggatgctggacgctatgctatccaaagggcaggaggacgagaacggaatcctgtttgtctgcttccctgtcacagccattgccgcagtcttgtcccgcagccccatgacggtcaagcgttctttgaatgaactggaaaccgccggacttatcatgcgggtgcgtcagggcgttggagaaccaaaccggatttatgtactgataccgggaaagggggacgctgcccttgcctgatacctcaaagctggaaaagctaaaccgggagctggagaaaagcgaaaagaaactgcggaaagcaatcaatgatgaaaaggcattgcagcaccagttaaagcagcttacccgaaaggaacggacgcaccggctctgtacccgtggcggtatgctggaaagttttctgcaagagccggaacgcctgacagatgatgatgtcatggtgttgctcaaaatcatttttcacaggcaggacacgcaggaactattgaaaaaactgctggaacggaagaagccggaaaccccttagtttactaagggcgcaattatacaccacccagaggttggtgcattgcgttctccgaaggctcctcgccggagggctgtgattttccgcagtcatggtctgctccaaatcatacaggggacgctacgcttcccctgcgctggctgccgccagctacccttttgtggacttgccatctggggacaccttgcgttgcaagctgttcccagccgacaagtttcataaaatatgctatcttttcgatagccaatgaagtataatgaagatgacaacaaatcggtagttgacaaggagttttgatagcgtgaaaaaaatatttcttaaaattgtgataggggttgttcttgcttgtattttatttgtttgttttctttatacgaacaatgagatcggcgtgacttcatctaagctggaggcagatattcgttcgtcgcagaagattaaggatgattggacggtcgatggaagcgtttccagcacgatggctgcatatatttcttaccctcaggatttgagtgaccattctttttccgtctatgtcaaccgtcctggtctttcctttggatactttttccgtgggggtggaaacctttcgggggttcaaagaggaattgccgagtacaccgtagaaggatataatgagcgagcatttatttctatgaatcagcaacaggtaacacagcttgaaatagatgacggcaacacaattcaagtgcttgacattgacagcaataaaccttttgcgattgttttgcctataagtgcgggaaccattacattctatgatgtgaatggcaatactgtggaatactggaacaattctctttgacaacttccagtttgtcagcttcacatcgggtcaacttgccccgaacttttacaattaaatacccgccgcccacatagcggcacaccgagcaggaaatctgaaaaaggtctcctgctttttttctgcccaaaatgagatggtaaaacgccaccccgtccaccaattagcgaaaggagggacacgaaatgccctgtccacacaacgaaatcacgattgttcagcgcagccagcggcagtctgcggttgccgccgctgcttaccagagtggcgaaaagctgttctgtgaatacgaccagcaagtgaagcactacccggaaaagcgtggtatcgtccacaatgagattctgctcccagcaaatgccccgccggagtatgcagaccgtaataccttatggaacgccgccgaagcggtggagaagcaatggaactcccagcttgcaaggcggtgggtgcttaccatccccagagagataccgcctgaccagtacgctgtccttgtccgagagttttgccagcagcagtttgtttccaaagggatgattgttgactttgccatccatgacccccacccgccgggacacaatccccacgcccatgtcctgctgaccatgcgggcaatggacgaacatgggaaatggcttcccaagagccgcaaggtttatgacattgatgaaaacggggaacggataaagctgccgtccggcaggtggaaaagccataaggagaatacggttgactggaacgaccagaagtattgtgaaatctggcggcatgaatgggaggttatccagaaccgctatctggaagccaataaccgcccggagcgtgtggacttgcgttcctatgccagacaggggcttgatatagtccccactgtccatgagggggctgctgtccggcagatggaaaagcgtggaatccagacgaatatcggcaacctgaaccgggaaatcaaagccgccaacagtttaatgcagtccatccggcagctcatccacaacctcaaaggctggattaccgagctgggagaaaaacggaaggaactgcttgcacaaaaggaggcggaggaagcgacacttcttcccaatctgctgatgaaatatatggagatacgaaaggaagaacggaaggactggacgagggctgggcagaaccgggggacttccaaagacttaaaggcagtcagcgaagccctgtcctatctccggcaaaaggggctttccactgtggaggacttagaagcgtttctggaatcttccgggaaatcagccgcagattaccgcaatcagatgaagccaaaggaagcccggagcaaagtgattgacgggattcttgccagccggacagactgcaaggaatgtaaggctgtctatgagaagtaccagaagatattttttaagaaaacaaaggagaaattcaaacaggaacacccggaggttgcccggtatgagaaagccgttgactaccttgccaagcacccggacgataaggataaaacgaaaaatgagttgcaacaggagcaggaaacgcttctcagcgaaatcgcagagctgaaagtaccactgaccgaggtacaggaggatttgaagaagctgcgggacatccgctactgggtacggaaagccacacccggcacagaggaaagcaaagagccgcccaagaagcagcccatcaaagaagtcttgcaggataaggcagacgagaaaaaagcacaaagaacagcccaggcacagacgaaacacagacaacaggatatggaactttaacaggcacttgccattttcaatcagagaatgtcaggtgcttttctttttttcaaggagggatagatttgaatgtatttgaagttgtgaagcagtccgttacaacaagacaggctgcggagcattatggaatccatgtaggtcggaacgggatggcttgctgcccgttccataacgataaaaccccaagcatgaagctggataggcgttaccactgcttcggctgcggtgcggatggggatgtgattgattttgccgccgccctgtatgggctgggaaagaaagaagccgccatacaactggcacaggacttcgggctttcctatgaggattggaagccgccgggaaaggcgaaaaagcccaagccccggcagaaatcccaggaggaacagtttcaggaagcaaagaaccgctgcttccgtattcttgccgattatctccacttgcttatggcatggagaacggactacgccccacactccccggaggaagcctttcatccccggtttgtggaagccttacagaagcaagcccaagtggaatatcagctggatgtgctgctgttcggggaaacagaggaaaaagcggctttgattacggactacggaaaggatgtgatacagcttgaacagcgaatggcagagcttgccgccacagacgcagcaggaactaaaaaacaccatgaacgccatgcagccgccccagagcgcccctgaaatcaaggcggggctggaaaccaccgagaaaggcggtgtccgtcagagcatacggaactgcctgaccgtattccagcgtgatccgctgctttccggagctatcgcatacaacatcctgaccgaccgcaaggacatcataaagcccatcggcttccacagggaaagcaccgccttaaacgatacggacatgaagtatctgcttctctatctggaagaaacctacgggcttaccaatgagaaaaagattgataacgccatcggaattgtggcgaatgaaaacaagtatcatcccatccgggattatttaagttcccttgtgtgggacggaaaggaacgaatccgcttctgcctgcggcactttctgggggctgacgcagatgattacacctatgaagcgttgaagctgtttctgatgggcgctatctcacgagcctttcagccggggtgcaagtttgaaatcatgctctgtctggtaggcggtcagggggctggcaagtccactttcttccgtctgctggcagtccgggatgagtggttctccgatgatttgcggaagctggacgatgacaatgtgtaccgcaagctgcaaggtcattggattattgaaatgtcggaaatgatggcaaccgccaacgccaagagcattgaggaaatcaagtcgtttttaagccggcagaaagaggtttacaagataccttatgaaacccacccggcagaccgcccccggcagtgcgtgtttggcggcacttccaatgcccttgacttcctgccccttgaccgttccggcaaccgccgctttatccccgtcatggtgtacccggagcaagccgaggttcacattttggaggacgaagctgcttccagagcctatatcgagcagatgtgggcagaagcgatggagatttaccgaagcggcaggttcaagctggctttcagccctgccatgcagcggtatctcaaagaacaccagcgggattttatgccggaggacaccaaagccgggatgatacaggcgtatcttgataagtacaccgggaacatggtctgctccaagcagctctacaaggaagccttaaaccatgcttttgacgagccgaagcaatgggaaatccgggaaatcaacgagattatgaaccagtgcattgaccgctggcggtatttcccgaacccaagaatgttttccgaatatggcagacaaaagggctgggagcgtgaaaacccggcaacggactccggcaacccgtctgaaaaaacgatggacggttttgtggaggtcacagaacagatggagcttccattctgaaaatgacagcccgttgcaccccctgttgctatcccgttgtcgagccggttgccggggaaaatcccataactgcgggcttttctcccttataacaaccaaaacaacagaaaaataaaagaaaagtataaatagtaaccatcgccagattgagattgtttgcaaggtcttttgaagcccgttgccggacttcgttgccgacaccctctgtctggctattttcatgtatggaggataactgcctatggcaaaaaacaaaacagagattcatgttacaacggtgtttgacggggaactggacgccactgatgtgttcgtcagcctgatttcccagaaatacggcaagacaaatacaaaagaatatcttgctaaaaagaaagatttgaagtataatgaagatgaggttcaaaagagccagataccgtctggattgtgtgggtaaatggctatgatgaacgaaatggaatacagaacaatcggttcggcacttgccgggggctatcgtgcagcggtctattgcaggctgtcaaaggacgatgacctgcaaggcgaaagtgccagtatcgcaaaccagcgtgatatgctggaaaaatactgcgaaaagcagggatgggaggttgtggcagtctatcaggatgatggcttcacaggtcttaatatggagcgtcctgatttacagaggatgttgagagccattgagcgcaggcaaatcaaccttgtcatcacgaaagacctcagccgactggggcgtaactatctgcaaaccgggcatttgattgaggactttttcccaagaaacggtgtccgctatattgccatgaatgacggtatcgacaccctgcgggataacaacgacatcgccccgttcaagaatatcctgaacgagatgtacagcaaggatatttccaagaaagtccattcctcttatcttctgaaagcgcagaaaggacagtttaccgggtgtcttgccccgtttgggtatcggaaagacccggaggacaaaaaccatctgctcattgacgaggaaaccgccccgattgtgcggctgattttcggatatgccctaaacggtcatggtccgaactatatccgcagacggctggaggaagaaaaaatcccctgccccacatggtggaaccgggaacgggggcttcgcaatacccgcaccaaatgggaaaagaaagacccggaaaacgggcggtatatgtgggacttctccgttatcaaagaccttttgatgaatcccgtctacaccggggcgattgcttcccagaaaaaagactaccgtttcaaaatcggcacgattggggaaaagaagccggaggactggattgtggtggaggggcagcatgaaccgctgattgaccgcatgagctttgacattgtgcagaataagctgaaatcccgccagcgtccggggcagaccaatgaaatcagcctgtttgccggactgataaaatgcggcgagtgtgggaagtcgctgacggtacgctacacaaacgcaaaacatccccagcagatttattcctgcaagacctacaatgcctttggaaagaaccactgcacccagcaccggattgactatgacaccctttacagccatgtgctgcggaaaatccgggaatgtgccagagctgccctgatggacggggaagcggttgccggccgcctgaccaatacctgtgaagccgagcagcgggaacagcgggaagcaatggaacgctcccttacaagggacgaggaacggattgaggttctggacaaaatggtcatgcggctttatgaggatatgattgcagggcgtatcagtgagcagaatttcaacaccatgctggaaaagacacagaccgagcagacggagcttaaaacaaaagtgtccgagggcagaaagcggctgtccgatgaagtccagcttgccaatgacgcaaaacaatgggtggaagccattcaggaatatgccaacatcacagagctggacgcagccaccctcaaccgcttaatcaaagaaatcgtcgtgcatgaacgcattgacgaagataaaacaagacacatttctatcgaaattcattttaatctcaaacctatcccggaggtggaacaggtcactgcctgacctgtcccgccgggacggttctcttaaaaacaccatatagattttttgtacgccgccgcccgccatcgagcagagttttacacctaattggggataaaacagctgatggcaggaggcggtgtcgttctgatcggcacccagctggtaccgttactgtccggattgttcagctgagagaagcaggagggagatgactcatggatcggatatttgaagcgattgaagaatggatgaggaatcttctgacaggcatggtaagttccaacctgacaacaatgtataccgatgtcaatgaaaagaccggtcagattgctgctcaggttgggcagacaccgcagggctggaatggcagcatttacagcatgatacagaatctttccgagtcggtcattgtaccgattgccggtatgattatcacatttgtactttgttatgagctgatctccatgttgacggaaaagaacaacatgcacgacatcgacacctggatgttctttaaatactttttcaagatgtgggtggcagtctggatcgtcagccatacctttacgatcacgatggcggtatttgatgtcgggcagtccgtagtcagccgggcagctggggttatcagttctgatacagcgatcaatatagatacgatgatctccacgatggagacggcgatggaatctatggagatcggtgaacttgtcatactggcactggaaacgatgcttgtaagcctgtgtatgaagattatctcagtctttattacagtgattttgtatggacgtatgattgagatttatctctattcgtccgttggagcgatcccgttcgcaaccatgtccaaccgggaatgggggcagatcgggaacaactatcttcgtggattgtttgcactggcattccagggattttttatgatggtctgcgtgggaatctatgcggtcctggtcgcaaacatccagatgtcagataacatacattctgcattgttcggcgtgatggcatacacggtgatcctgtgtttcagtctgatgaaaacaggaaacttcgcccgcagtatctttaacgcccattaagaaaggaggaactggcaatggcatttgtatctgtgcctaaagacttaaccaaggtcaagaataagatcattttcaatctgacgaaacggcagctgatctgctttgggattgcggcggcggtagggcttccgttttatttcttaagcaggggaattattggttccagtaacgcagcgaccgggatgtgccttctgatgcttccggcatttttgtttgccatgtatgagaaggatggactcccgttagaaaaggtcttaaaaaatatgatcaccgtaaaatttatccgtcctccggtacgcaagtaccagatggaaaatatgtacgagaaaaagtataccgtggtcaaaaagaagaaagggggaacgaagggtgttaaaaagaaaaaacgatagacagccgccacagagcttagacgaattatatccggatgattactggctggatgaggaggatggagaagaagaacttccagaccccgcaatgaaaagaaaaccagtaagcggcagactgcatgatgagcctatggtgacagggtatgaagcactggaacggcaaagaggtgtccgcagaccgaatcggaaactgacacgcagggaaaagaaagccctcaaaagggcacagaaatatgaagaaaaactgcataaggaacatgaaaaagcggataagaaaaatgcaaaaagggaagcaaagctggcagccagagcagaaaagcaggcagtgcgtgacgcaaagaaaaacgcaaaaaagaaaaagagcagatctgtcgcagcaccgtcggggcagcgtccggcaggaaaagtggtttccggaacgaaaggcagtgggacaggaaagaaaacaccggatagtgccagagataagaggatcactgcacagcagtcgattccataccatgagatgggaagggacggtatctgccgggtgcaggacaagttttattccaagacgatccgtttttatgacatcaactatcagctggcacagaatgaagataagaacgccatctttgaaaactggtgtgatttcctgaattactttgacagcacaattcattttcagctgtcttttatcaaccagcacagcaacatggcagagtatgagaaggtcatccatatcaatccgcaggaggatgaatttgatgacctacgtatggagtttgcccagatgctcaataaccagctggcaaaaggaaataacgggctgatgcgtaccaaatatatcacatttgggattgaagcggagaatatccgggaagcacggccaaaactggaacgtatcgagtcggatattctgaataactttaagatccttggggtatctgcctatccgctgaacggagaggaacggttacagatcatgtatgaaacctttaaccaggacagcaaagttccgttccatttctcttatgacgatgtacttcggacagggcttagtaccaaggattatgtcgcaccgaccagttttgtatttaagaatggaaaagattttgagatgggcggcacgatgggaactgtttcctatttacagatccttgcaccggaacttaccgacaagatgctggcagagtttttggagatggacagcaacctgatggtgaatttccatatccagtccatcgaccagatgaaggcaatcaagctggtaaaaagcaaggtgacggatattaaccgtatgaagatcgaggaacagaaaaaagcagtccgggcaggctatgacatggacattatcccttcggacttaaatacatacggtggggaagcaaaaaggcttctggaagatctacagtccagaaatgagcgaatgttccttgtaacagcattgttcttaaatactgcaccgaccaaacaggaactggaaaatgtggtgttccagactgccggtatcgcacagaaatataactgtgcattgaaacggctggattaccagcaggagccgggactgatgagctgcctgccgcttgcggtgaattttgtaccgatcaaacgggcactgacaacgacatccacggcaatttttgtcccgtttaccacacaggaattatttatggctggggaatctatttattatggattaaatgccctgtccaataaccttatcatggcagacaggaagaaactgaagaacccgaacggactgattcttggtacaccgggttccggtaagtcgtttgcggcaaaacgagagattgcaaatgcatttatcgtgacgaaagatgacattatcgtctgtgacccggagggggagtattatccgttagtccgggcatttcatggacaggtgatccgtatttccccgaccagccacgattatatcaatccgatggatattaacctggattacgctgacgatgatgacccgctttccttaaaatcggacttcatcctgtctctttgtgagctggtagtaggcggaaagaacggactggagccggttgaaaagaccgtcattgaccgatgcgtaaggctggtctatcaggatttcctttctgacccggtaccggaaaaaatgccgattttagaggatttatataatcttctccgtaatcagaaagagcaggaagcacagcgtctggcaacggcactggagatttacgtcaatggttccttaaaagtgtttaaccatagaaccaacgtggaactgagtaaccgtatcgtatgttttgacattaaggatctgggaaaacagctgaaaaaactgggtatgctgatcgtgcaggaccaggtgtggaacagggtaacggtcaaccgttctgcgaataagagtaccagatattacattgatgagttccatctgctcttaaaagaggagcagacggcagcatacagtgtggagatctggaagcgtttccgtaaatggggtggtatccctacgggtatcacacagaacgtaaaagacctgttagccagccgggagattgagaacatctttgaaaactcggactttatcctgatgctcaaccaggcatctggtgacagacagatccttgcaaaacagctcaacatttcccctcaccagctttcttatgtaacgaacagcggggaaggtgagggactggtcttttatggcagcaccattatcccgttcaaggataagtttgataattccctgatgctgtatgccctgatgacttctaagccggatgaggtggaaaagcgtaagaaacttggtatcggagaacgggacgattaaagaaataaacgaaacaaaataaaacagagtagaggatgagccggaggaatacttccggcaatttttctgcctggaaatcatggaggattacaagatggaagattacagaaacatggagagatgcagcggcgaaccttgctgcatatttgcagaaagaatctgtgcagacaatgaaaaggagattttgagaatggaaaaggacacaaaggaaaaagtgacggctgatgaaatgatggatgaccttatctatctggcggaactgattgatttcatgggaattacatcttgtctggctgtaaggggaactttaagtgagcgaatgacagacaagctgacggattccattgcagggatggcagatgaagtgttggagaaatgggagaactatcaggataagacagaataaccgggacaaagcagtaaaggggatggtcaaagttgcaggagcatgagtataaggcgagagataaaaccgtccagaagatgagccgggatggactgcgggaagaaaacctccggaacaaggaagaaaaaaggatcaccgggcgggatacggataccgagatttcccgcagtgagaagaaagaggaactggattttagtaaacgcagacatgaacggctgaaagaagaacgggagatggaacagccggagcagagttccagaaaaccaagatatagtagagattatgtatccgaccaggatataaaaccagatatggatgaagatgtagatacagatgtagatgtttctgttgaaaatggagaaaatcccaaatctgcatttcgcacagagagtatccgtggacagccaagaggagaacgggcgtatctggagacagttgcggacagccgggaccttcggaagaaaaagatggtcagggattatgctgcaaaggaaagaaggaaggaaaaggaggcttccagagaggaaaaagcagccaaaagagaatctgcccgttaccgggcaacttccgaagtgatggaagattccctggacgagttccaggaggagattaaaggcaagtccaaaagggaacgggtgctgaaagagcagcggaaaaaagtttcccgcctgtctttcggggatgaaggtgacggtatggtacatggtgctggcattggtatccggaatccggcatccgcagtcaaagatgcggcagtcactgcagcccattggaaaactcacgaagaagaggacgagaatgcggcagtagaaggggcacatcgggcagagcttgccggggaaagccttgcaaggaaatccatttacatgaggcaacgcttaaaaggaaggagggaagaatcccggagattaaaagaaagtgtactggatgaagcagaaaagagcaggctgatgtttgaaactgtctatgaaaataaagcaaaaaatgcagtgaaaaaagaagccgagcagaaaaagaaatctgctctgcagaaactctttcagaagaagcgttaccagaagcagtatcaggcagccagacagagtaaaaaagtaaaggatgcggcgatcacttccgcacagaagtttacggaaaaagcgaaagatgcagtcaagatggtggcagcacagaaccgtgggatttttgctacggtagccatttttgccctgatctttttgctgatcgcagccagttttaccagctgtacggcatcactgcagggagcgtcctctgctatcatctcgaccagttattccagtacggatgaggatatttatgctgctgaaaatgcgtaccgggctttggaagaagcactgaacacacaggtcaaccagatggaatccacccatccggattatgatgaataccggtatcagattgatgagattggtcataacccatatcagttgatctcttatcttacggtaaaatacggcggcttcacttacgatgaagtggcagatgagattaaggagatcttccgacagcagtatggaatcaccacagactctaccagagaaacagttacagaaaccaagactgtccgggtaggggagtccttgggactggttgtgacaagtgggtactgtaactgcccaatctgctgtggccagtggagtggcggaccgacagccagtggggcaatgccgacagcaaaccatacgattgccgtggatgcggcgaatccatttgtgccgatcgggacccatgtcgtcatgaacggtgtggaatatgtagtagaagataccggagcgttcgcaagatatggggtacagttcgatgtttactatgacaatcatgcggcggcatccgcacatggacaccagacatgggaagcctacatagcagacagcaatggaaaccaggaagtgcaggtcacgactacaaaagaggtgaaccgtctggatgtgacgatgacaaaccacagcctggatgccgtgttaaggagccgtatgacagaggaagaacaggaacgctacgatgcgtataacaaatattacggcaaccgtgattatctgtttgatctaaacagcatacccaccggaagcagtggatttggttatgacataccggcagatgctttatctgatccacagtttgcaaaaatgatacaggaagcagaaaaatatctgggtgttccatatgtatggggcggttattccccaagtggttttgactgttccggttttgtgagctgggttatcaataactgtggaaatggatggaatgtcggaagatgtactgcagatgagctgcggtcacactgttcgcaggtatctccatcggaggcaaaaccgggagatctgatcttcttccagggaacctatgacacaccgggagcaagccatgtgggaatctatgtcggcaataacatgatgatccactgtggcaagcctgtccagtataccagcattgcaagtgcttactggcaggaacattttatggcgtttggtcgtctgcattaaaggaggtgacagggcagatgaacatgaaattaaaaaaacttctgaatgatattcagaaaacggaggataagattgctgaattacaggaacacctgaagcggcagaatacattgagacagcagatggaagatatagagatcgttaagtcgttccgttccatgaagctggacagccgcagcctgcttgtcctgcttgacgggattcagaaaggaaccgttacgatccagatggatgaggacggtggtatcacggtggaggatgcaaaagctccgcagaaaaaggaaaacaacacagaagttcacagaccacctgttggtcagatgacagaaagagaggttttagacgatgaggaataaagtggtaaagaaactgcttatgattgccatggcagtcaccatgatctccgggacatccattgctacggtttatgcaaatgcaaacccaccggcagaggagacaacgacacaggtagtagaagaaacggcaacagaatcaacagaagatacggagaagaaagaggataccggaagggtcaccggggaaggagataattctgctttttctactccgggaaatgcccagctggtggatgataaggaaaatgatgatacgaaacagttccttaccatccagaccaagaagggaaatacattttacatggtcattgaccgttccagcaatacagaaaatgtatatatgatgtccctggtcgatgagaatgacctggcagaatttctggatgagacagaaaagagcaaagaaaccgaagaatcaaccgtagtgatcccggaaaccacaccggaaactaccccggtagcagaggaggaaaccgaagtgaagaaagaagaaaagacaggaatgaatgtaaaaggacttggagcaatcgtacttgcagcgattcttggagtggcaggtatcgccgtttataaaaagcatggacgtggcaaagaggatgactatgtaagcgaacagctggagttctctgacggaccgtatgtaaatgaagaagaggatgaggaagaagaataaacttccatctccaaagaagcaaccaaaataaggacaggggcagccagagcagtttggctgcccttttttcagaaaggacaaaaaaagcgtatgtcaaaatttttagtgatcgcagagaaaccaagtgtggcacagagttatgccaaaaatctgtcagcttataaaaaagaggacggatatttagaaggggagagctgtattgtcagctggtgccttgggcatctggcagagtatgcacagccggaggaatatgacccgaaatatgagaaatggcagtttgatgaccttccgattctcccgcaggtctggaagttgaaagtttccagagataaaaagaaacagtttgatgtgttaaaaagcctgatgaaccgggcagatgtggactatctggtaaatggctgtgatgcaggaagggaaggggaactgatcttccagagagtgtatgaccttgccggatgcaggaaaccggtgaagcgtttatggatcagttccatggaagatacggcaatccggataggttttcagacaatgaaaggagcagaggaataccggaatatctgcatggctgcggtatgcagggcacaggcagactggctgatcggaatgaacggaactagggcatatacgacctgttattttaaacgtctggttgtgggcagggtgcagacgccaacgcttgccatgcttgcggaacgtcaggataagattgagcattttcagaaagaagccttttataaagtagcactgacagacggaaggcttacggtagtttctgaaaatattgcaaatgaggaagcagccgatctccttgcttccttatgtatggattcggaagcagtgattacacagataaagagggaacaaaagaaagcgtttcctcccaaactttatgatctgaccagtctgcaaagggaagcaaaccgttactttggctatacggcaaagaaaacactggatatgctgcaggaattatatgaagaaaagctggtcacttatccaagaacggacagccagttcgtgacggaggatatgggggataccgtagaggaactggtagggaaaatgccagtcttacttccgttcttggattatggacagctgggacataacatcaccagagtgattaacaatgcaaaagtatccgaccatcatgcgattcttccaacaaaagaagccgtagaaaaaggaatctctgatctgacagcggacaaaaagaacctgatgatgctggtctgccagcagctggtgcaggcaacaggggaagagtatcagtatgagcagacggatattatggtcaaatgtcagggacatgattttaccgccagaggaaaagtgccggtgcagatgggatttaaagcggcggggaatgcctttaagaaccagtgcgtgaaagccaagccggaagaagaaacggaaaaagaaacttccatcccatatggatatgaagaaggaatgacgctttctccggtaaaggcagaaaagacagtgcattttacttccccgccaaaaccattcaatgaagataccctccttgccgctatggaaaccgcagggaataaagactttgattcggagacagagaagaaaggactggggactccggcaaccagggcaggtatcattgaaaaactggtttcttccggctatgcagtcagaaaaggaaagcagatcttgccaagcacagagggcagggaactggtgaatgtcatgccggcttatctgaaatctgccgcaatgactgccgaatgggaaaatcagcttttaatgatggaaaaagggcagatcaccgatacacagtttatgggtgagatcacttctttagtcggtaagattctttctgtgtgcagggaaataccggaaacggaaaggagaaggttccagaaagcaagggaagtgatcggtaagtgtccggtctgcggctctgatgtctacgaaggaaagcagaatttttactgctccaacaggcagtgtgattttgccctttggaaagaaaaccgtttcttaggaagcatggagaaaacactggataaaaagatggcagtggagcttcttgataaagcctgcacccatgtaaaagggctgtattccagaaaaaaagatataaagtttgacgcagatcttttactgacactggaggacggaaagccaaggttccatctggaatttccaaagaagaaaaagaaataagacaaggaggtaggcagtatgtcgaaattacaggacatccgggaactggcacaggaacatgcgacattggtgagcagttcgccaagggactggatgggttatatggataccgcagcgagactataccggtatccttttacagaccagttactgatccacgcacagcatccacaggcaaccgcctgtgcgtccctggaactgtggaatgagaagatgttccgctgggtaaaccggggagctaggggaatcgccctgcttgacgagaatggtcataataccagactccggtatgtgtttgatatttcagatacgcacatggtggcaggcggaagaagcccttacctgtggcagatgcaggaacatcagcaggaagagatccttaaccatttagcagaagcgtatggtctggaagaaaaagatacagggactttatcggatgcgttgatggcggttgcaagggaaatggtcgcagacagtctggaagaatatctggacggcttggaatatgcagcggaaggaacgtatctggaagatctggatgaagttacgatccgcagtgatttccgccagcttgcaacggacagtgtatattacatgctttccagacgatgcgggcttgaaccgatggaacttctggaagaagaggacttcatgcatatcacagattataaccggctgtctgtactgacctttcttggaaatgcagcaagccagatcagtgagagtgttctgattgacattggaaggacggtacataaaatttctctggaagaagccagaaaagaggttgaaatttccaatgaaaggaattataataactttaacacgttaatgcgtgaaaataaaaataagggcgtagaaaacaacaaagaagaaaatatcgagaatgaaggaggaaccgactatggaactgacatatcatcgcaagggggattacctgtttccgaacctgaccgtagaggaggaagaagtgacaatagggaaatacgggatgcttcggaggacattcctgaaggaacacaagaacagcctgtatcagagcctgttcctgacaggaaagctgaacagccatctggcagagatcgagaaggcagcacaggagaggatggacagccagatggagaaactgctgaagaaccatccggcaccggacaaggaagcagacccgatggcctggacagcacatatgaacgcactgatggcaacagcggaagagagcatcttgacggaattggtatacagctagttgaagatacaagagaagatggactgagcaaagcagaggaagaaattgcctctgctttatctttgcccgaatatcctacagcaaatgaacagaaaaggcagattggtgaaagagtagctgctttatatgccggggagattcctattccggaaagtgttgtggatgatattttacggacgggaggaaaccggacaggaagccagctgcgtatcatctataactttatgagtgaacagtcaccgggagaatacacggagtttgtaaagcgtgagtatggaaaaggcggcaaaggttttcagatggatggaagggagtattccgtctggtttgatgaaactgggatgcagatcgcagtcgggcatacggtggcagaccagattctggataaagcctttttatcctggaaagatgtcagcagacgtatccatcagcttttagaccagggtgaatatgcaccgcagtctgtattggatgcagcaagaaacaatgcagtaaaagaacatgcacaggctcttgcctatatgaaaggggatatggcagaaggggtagccgagattgtttttgatgaggaggatttaccacatcttcacagtatctatccggagatcacggattatctggaagaaaagctggaagatccacagtggctttcggaactgaatgaaagactggatgcactggcagaagcctatgaagaaaatcattccattatgcgtttccatcattatgatcctataaatatctcaaagcagtttcagaagtttgcggatgaggtcatcccttatcaggcaagagacgggtttgcatggaaagaccatccgatgttcattacgcaggatgagattgatgcttatcttgcaggaggtggagcgtattcgcagggcaggcttaggacgtattccttttatctgctgcatgaagatgaaagatcgaggacaggttttatcaaggaacagtatgggatcggtggaagcagtcatgcactgtctggtgcggatgattcacacgcaaattatgatggaaaaggattgtttcttgcaagaggtgcttatggaaatccatatacgtcagttttattatcttggaataaagttgcaaatagagtagcttatctgataaagaatgaccagttcctgcaggcagaagattatgctcgtatgccggaatatgaacaggaacagatggcgaacaaggtactccgcttttatgaccgtcttccggaagagatagacagaccatttacggatgatttcttctgggaaaaaccaggaaaagaaatggtggcagtattagagaatccagagcagacagaagaactgttacagaagatggatgcagcattggcagctcttccattggattttgaagcgtatgggacaaactatcagcagaaaacagaacttctttcagaactccaccagtatgcagaaggaacctatacgatattcccgacaccggaagcagaaccgtcttttgcggaaccatccgggcaccagatgaccatgtttgatttcttggatacgaaggcagtgacagaaccgaccgtagtagatatgtcagatgtggaggaaatagaagaggaagaggttactgccaaagaagatattccggaaaatcaggaacaggaaataacagaaacttctgagggacaggaacaaaaggaatcagaagaagagataacggttaaaacagcagaagaactggcggagtcctgggatgaaggtgtttttgagtatcaggggtatcattttgaagcagtaggggtattgccggaaggaatagaaggaaaagatctggttgcacagacccgttccaatacagaactgcatttatcgacctaccatacagaagatttcccaaagtattcttatgatgatttttatgcagtcagcaatgcaccaactgccgatgtgttccggtgtctggaaaccggacgcaattatattccgggagaaaatgaactgtttggatatgagggagaatttcaaccatatttaaaaccggaagtagaagagattgtaacagaaccgcataactttcggattcaggataatgaccttggagcaggtggtccgaaagcaaagtataaagcaaatatggaagccatccatttattgcagactctggagcaggaagaacgtctggcaacacccgaagaacaggaaattttatcccgttatgttggctggggtggcatcccgcaggcatttgaagagaaaaacagtagttggacaaatgagtatctggagttaaagaataccttatcaccggaagaatacagtgcagcaagagcatcgaccttaaatgctttttatacatcaccgactgtgatccgaagcatgtatgaagcactggaaaatatgggactgaaacagggaaatattctggaaccgtcctgtggtgttggtaactttatgggactgatcccggagagtatgaacaaggcaaagatgtacggtgtggaactcgacccggtttcgggcaagatcgcaaaacagctttaccagaaaaataagattgccgtgcagggatttgaggaaaccagttatccagacagctttttcgactgtgtgataggcaatgttccgtttggatcgtatcaggtcagtgaccgcagatatgaccggcatcattttatgatccacgattattttattgcaaaatcccttgatctgatccgtcccggcggtgtagtggctgtggtaacttccagtggaacgatggataagcagaatccggcagtgagacagtatatcgcaaaccgggcagaactgcttggagccatccgattaccgaataatgcgttccagagaaatgccaataccagcgttgtttctgatattctgtttttccagaaaagggacagggcatccattgaggaaccggaatggttaaatttaaaggaaacaccggaaggctattcagtcaatgcttattttgcagagcatccggaaatggtgcttggtgagtttactacagaaagtacccagtatggaaagcaggaagtgaccgtaaaaccaaaagaaggaattaccttagaagaacaattaaaagaagccgtccagaatatccatggtacgatcacggaactggaactttcggatacagagttggaggaggatgttgtctctatcccggcagacccagatgtaaagaatttcagttataccgtagtgaatgatgaagtctattaccgggaaaattctgtgatgaatcggatggaacttccggcaatgacagcggaacgtgtcaaagggatggtgaagatccgtgatgttacgaatgaactgatccagtgccagatggaagagggaagcgatgaacagatcacaaagctgcagggaaaactcaatgaagaatacgatacctttacagcaaaatatggtcttctcagcagcaatgccaataagcgggcatttagtcaggacagcagctattgtcttttgacttctctggaatttctggatgataagggagaactgaaacgaaaagcggatatttttaccaaaaggacaatccgcagggcagaaacggtaacttctgtagatactgccagtgaggcacttgcggtttctatcggtgagagggcaggcgttgacctttcttatatggcacagctttccgggaaaacagaagaggagcttaccgaagaactggcagggataatctttaagaacccgatcagtgaaaaatgggagccatcggacgaatatctttctggaaatgtgagggagaaactgcagatcgccaaacagtttgcagaggatcacccggaatatcaggtgaacgtgcagtatttggagcaggtacagccaaaagatctggatgcatcagagattgaggcaagacttggggcaacctggatctccgaggattacattacacggtttatggcagagacattccatacaccaagatattatgtagggagcaaggtcaaagtccagtatgcagaagtgaccggacagtggaatgttatgggaaagaatgtggacagctacggaaatgctcttgtcacttccacatacggaacacagagagccaatgcctaccgccttttggaagatgccttaaacctccgggataccaagatttatgacacggtacaggatgccgatggagaacaccgggaattaaaccggaaggaaacgatgctggcacagcagaagcaggaactgatcaaagaggaatttaaggagtggatatttaaagacctgcaccgacgggaagatctctgtaagatctataatgaacgatttaacagcatccgtccacgggaatatgatggaagccatattcagtttgttggcatgaatccggagatcaccctgatgccgcatcagaaaaacgcagtggctcatgtgctgtatggaaataatacgttactggctcattgcgtaggagctggaaagacattccagatgatcgcagccggtatggaatcaaaacggctgggactctcacagaagaatctttatgttgtgccaaaccatctgaccgagcagtggggcagtgatttcttacgactttatcctggggcaaatatcctggtggcaacgaagaaagactttgagccggcgaaccgaaaacgtttctgttcccgtattgcgacaggggattacgatgctgtgatcatcgggcatacacagtttgagaaaatccctctttcaagggaacgtcagattgccatgctggaacagcagattgcagatattacgttctccattgaagaagcagcacatcaggcagggcagaattatactatcaagcagttggaaaaaacaaagaagagtctgcaggcgaggatgaagaaacttaatgaccagaccagaaaggatgatgtagtaacttttgagcagttaggcgtagaccggctgtttgtggatgagagccatagttttaagaacctttttttgtatacaaaaatgcggaatgtggcgggaatctcacagacggatgcacagaaaagttcggatatgtttatgaaatgccggtacatggatgaactgaccggcggcagagggatcacctttgctacaggtactcccgtatcgaacagtatgacggagctttacactatcatgcgttatctccagtatgacacactcatgcgtatgggtatgggacattttgattcctgggcggcaacctttggagagacagtaaccgcaatcgaattatcaccggaaggaacgggctatcgtgcaaaaacacggtttgcccgtttttttaatcttccggagctgatctccatttttaaggaagctgcagatattcagacttctgatatgctgaaccttccagtgccggaagcagagtttatcaatgaagtcttgaaaccaagtgaagaacagcaggaaatggtcagtgcattttcagaacgtgccgaaagtgtaagggcaggcttagtaaatccgaccgaggacaacatgctgaaaatcacgaatgatggaagaaaatgtgcccttgaccagagactgttgaatgaacttctcccggatgccgaaaaaagcaaggtcaatacctgtgtggaaaatgcttttcaggtatgggatgagggaaagacagaccggacaacccagctgatcttctgtgacctgtccacaccaaaaggggatggcagtttcaatgtttacgatgatgtgagggagaagctggttgccagaggaatcccgaaagaagagattgcttttatccatgaatataacacggaggcgaagaaagcggaactgtttgcaaaggtgcgggccggacaggtgagaatcctcatgggttctacaccgaaactcggtgctggtaccaacgtgcaagacaggcttattgctctgcatcaccttgactgtccgtggaagccgtctgatctggaacagcaggaaggacgtattttaagacagggaaaccagaatgacaaagtaaagatattccggtatgtgacggagaacacttttgatgcgtatatgtggcagattttggagaataagcagaagttcatcagtcagatcatgaccagtaaatccccggtcagggcctgtgaagatgtggatgatacggcactgtcctatgcagagatcaaggcacttgctacaggcaatccgtacattaaggaaaaaatggatctggatgtgcaagtgagtaaactgaaactcttaaaggcaaaccataccagtcagatttaccgtctggaatccgatattgcaaagaatttcccggtacagatcagtgcattgaaagagcggattgccgggatgcagatagattcccaggtagtaaaaagcgtggatttacaggataatgacacgtttgccatgacagtaggaaatgtcctttatgaagataagaaagaagcaggcgaggcattgatcgctgcctgtgcaggactaaaaaccgttagcaccggtggaaaggtcggggaatatcatgggtttacgttatctgcttcctacaatatgttctccaatgcatttgaactgacggtcaaagggaaatgttcttataagctggagatcggaaaagacccggtaggaaatatgcagcgtatccataacacccttttttccattgacaggaagctgacggaaagtgagcagaaattggaaaccgtacaacagcagcttgcgactgcacaggaagaggtaaagaaaccattcccgaaagaagcagagctgaatgaaaagatggaacggttatccgagttaaatgcgttgctgaacatggatgaaaagggcaatgagacgattatggcagatgaggatattggcagagaaggaagtagcacagatagcagggatgctgtagaagaaaaagaacttccggaaacagcagacagaatccataagccatctattctggaacgcttaaagcaggagaaggcacagcagaatacagcggaacagccacctgtacagaaaactgcaaagaaaaaacacgaacaggagttataaaagatttcccgtcagagttttctctggcggggacataaaatggagggtttgtttatggcaaataatatagagaaacagttaaaggaaatatcggaacggctggaacagggcgtaaaggagatttttacttcggaacgatatacggaatatttgaataccatgtccaagttccataattacagttttaataacacccttctgatcaccatgcagaaaccggaggctactctggtggcagggtatcaggcgtggcagaagaaatttaaccgccatgtaaagagaggggaaaaaggaatccagattatcgcaccggcacccatccgtgagaaacaggagattgaaaagattgaccctgtaacaaaagagccggtgatcggggatgacggtcagccggaaacagagattgtggagatggtcattccaaggtttcgtgtgacaacggtatttgatgtcagccagacagagggagagccgattgtagagttggaagtaccggaacttaccgggagtgtacagttttatgacacgtttatggaagcattgcagaacatttctcctgtgccaatccgcatgatggaaatagaaggggaagcaaaggggtattatcatcagacagaaaagtatatcgcaattcaggaagatatgagtaatcttcagaccatgaaaaccggagtacacgaagtaagccatgcattgctgcatgaccgggaggtaatggatgcggaagggattttaaaagaccggacaaccaaagaagtggaagcagaaagtattgcctatattgtctgcaaccactttggtctggatacttccgaatactcttttacctatattgccagctggtgtgaaagcaaggatatgaaagcactccgggcatctatggataccatacggaaaacgtctgcggaagtcattgagaatatcgagacacagatgcacgagctggaaatggaaagaccagttcgggatacttttcataaggaagatttaattctgcatctttcaggcagtatgggttccgagtttacttatgatctgatcgaaaacatgagcagggaacagttagagcagaatgtgggggaatacgtccgccttctggaaagtggtgagatagaggaaaatgagaaaccactggaaagttttctggaagaaaaaggtgctgccgtcacaccactctatgacagcagtgggcacggagagaactatccgattgatttttatgatgtggaatatgatgctgacacaggcgttacttatttttctgacctttctccgaaagatcaggcagagatgctggtgcaaaaagcagagtttccaagaaatattttttcggaaaatgaaaaggcatttgtaaatgaatatgcagaaaccttccctggacaggtggaaagactgaatgacctggtatgggatatgagggaatcttacgatgaagccggttcaaagctggtgtatgaagtgatccaggcagcaagggcgaacttccaagcgaaagagccggaaattgcagaagaaacagccatgcagtatgcccaccgtctgattgaaacagcagaagctgccaatacgggagatttcacagattcccagagaaatcttattgtgaattttgcatataagatggatgataaagacgaagtgcttggactggtgaaccgtatgatgactgcaatccgcagaccgggaagtgaatatacgagaagccttatgaatgaaatacaggcacagattgacaatttcccggatggcatggttggttttacagaaatgcacgaggcaggaatccagttagaccatatgcttccgcttacgaaagaccgtgcatatgaattgtaccgtggaggggcagaaatttatgtgttacatggaaatcaagagaatccacagctggcagaatcaacacttgtagacacagaagatgcaattcttggatatgacggtatctttggaatcacagaaacagaatgggaagtgcagaaagaaagagaaatatctgctacaaaacaggaagcactggaacagcagagtgcagaaaagattgatgagacacttcttctgcatggagaaagcggaaggtttgccatttatcagatggatagtggggatgagcatacttatcagtttatgggaatggaatccgcaaagagtctgggatataccattgacggaaaggattaccggatggtttatgcagcaccatggatgccaacaatcacgttagaaaatatatttgaacgctttaacattgaccgaccggaagatttccgtggtcattctttatcggtaagtgatgtgatcgtgataaacaggggtgcagagattacagcctattatgtagattcttttggatttcaggaacttccggagtttgtccagcagagaatgaacatactggaacataattccgtcagggcatatccgccagtttataaaggaacattggaacaggcaatgggagaacgggatgtggatgcttatctggatttgagaaagttaaacctggactgcaagaaagcaatcgaagaagctatccgggagaattttgacgggctgcacttaaagcagaatgcagcaaaagaagtcgtggaacgctttggggaagaacgtatgaattttgttatggcaaataccatccaggaactttcccatgatggaagattctccagacagaacaaagactgggcggagcatattgaagtcccggaaaatatcagccggggcagaaatctgaatctggattatgtgatcgaaagccacccggcagttttagatgggtttatcgacatggcaagagctgagattcggatgcagaggatagaacaggcgataggagaaaacgaagtgacgattacggcagagacaagagggtatgaagcagaaggacataacggaacatggcatacggttgatgaaaaggaatatgccggggagaagtttttcttaatggaacaggatgaatttggatccgatgtggcaggcattatcgtagcagaaaatggacagcttgtagcggaggacttatggaacgggtttgacgcaggagcattggaagcagtttcagaatatttgcaggaaaatggaacaacactttatgacttgacggaattcccgaaagattctgttgtaaccctgcggagtggacagacacttacaatcgaagaaatacaggcagtacagaaagatacctgggaagaaacgatggcaggaaaaaatgaatctggaacggatgtccggtttaattttcatgcagtcagtgaggtgcagctgccggaaggcataaagttaaaaatgccagagattcattacgttgataatttttatgtgatggaagatgtaaatgcagagggtgtagtaaaagtaaaccggtatgaatcactggatgaagcgatgcaggaatatttacgtctgccaaatcatcagaaaaaagtgcttggtatccagaatacggaaacgatgcaggaaagcatggattttatccgatgtgaaaacgggatagatcggctgacccatgcgtataaacagatcggagggtggctgaatccagaaatatatgaagtggtaaataaaatggaaaacatgctggactggaatgaggtacagattgcatatcagattggaaaacaatactttacaatccagaccgcagaagatggttatgactatacattttataatgaagattatcaggaggatgatggaggaatctatgacaatccgacaatctatgtagatgaagctgccagtgatattttagaagataaagggtactcactggaagatgcaaaagtagtggattacgaagatctgatggcagatgtggaagaagttcaggaagaacagatgcagcggatacaattagaaaagaactgcccggcaagtatttttgaaggatttcgcagggaagaagcaatgcaaacctatgaaggaatcgcaatgcagtttaccaggagtaaagggtatctgaccatacaggcaacagaagaaggatattcgtttattttttatgactctgatctgcatgaaatccagagtggtgattacgataatccagacgcatctattcaggaagctgcttatgaaatccttaaaagtgaaagaatggatgatatggaatgtgtcaaagtggattataaagaatttgaagaaatgacgatccagcactctaaagatttattgcaggaaggggaacttcgtgcgacttctgagattggaagaaatgaactggcattaaatagtctgagcagggcagaagtagaaagaggggttctgtatcatgcacaggcagtattagaagatatgggaatggaacaggaggtagagctgcttgctgcaagagtgtatggttccagaagcagacaagacctttaccgggaagattctgaccttgatgtggttctttcctataaaggtgatattcgagaagatagctttttcaatgccttaaatgaatctggtatagcgatggcaggaattaaggtggatattaacccgattgcagaggagcgaatcactctggcagagtatataaaagaatccgaaaaatatcttgaccagcaggagattaaaaagctcgctgtggacctggataattttagttatgacattgatacctatgagtataacgatacggttgaaaatagagaagaacaggtggaaaagctcacggaggatattttgaataagaaaacagaagctatcaaggactggctgattgaggtatccgaggaatccgatatagacagcgatgttataactgcccgttctttacttttccgtctggaagatacagagcaactttctatctttgataaacagccggagcaggaacagccagaagccacgatcagtttttatgttgcagagtgcatggagtttccggtcatgggagaataccataacaacctcactttagaagaagccattaaaatatatgagagcattccggcggaacggatgcatggaatcaagggaatcggatttgctctgcaagatggtgatgaagattattccggggaatatgagttgatgagtgcagaccggatacggcgtgatctgatagatatgattcctcactataaagaaagtcctctggtgcagaaagcaatcgcagacatggaaaagtatctggatgaaaagcatggaagggtaaaggaaacggaacatacggtagaaacagtaataggaagtggacagaaaccttttgcggttgcggcagacagaagggcagagcaggaaccggtatctgtaagtcagagccagccacaaaaggcagaacctgcaagcagagcaaaaggtgaagtgaagaaatctgtgctgcagtctttaaaagattttcaggcaagggcaaaagcacaggagcagaataagacaacggagaaatccaagacacataagaagggagaagtggaattatgatggatctggcgatgaactttgatgcgaatgaatgtttagtaaccgcaatgtttgataaaggaaaccgaaatgacacgatggaggcaatcgaccatatcattccttttctgaaaggcgatgcagatatgattgggcttgtctgcaataccataagaaaactgttctgtatgagtgatgaaggttatgaagtttttcttatggatctggaagaatataaaatggaactgggagaggaggacgaagaatgagtacaagtcagtgtgcagtatatcaggtaaaagataccccagagtaccgggatgtccgtttccgttcttacgagaaactgaaaagcgaagaaaaaacagtccaagtagaaaactatcagcaggtgtacattggaagaatccagccggaggaaactccggctgacattaaaacacgcttgcagaagcaacgaccgaaaaactttaaaggtcattccatcggttgcagtgatgtgatcgtcatcactgatgatggaaaaaccacagcttactatgtcaacaaagatggttttatcatcattccggaatttctcacaatcaaaagttcctccgataccagactttccattgatacgaccggatatgaaatcgaaggaaagaaaggaacatggcttgcacaggattacatcctgatgaatgaaaagaaatggtttctgatggaacatgaggagtatgggacaagagccgcttatgtgattcttagtgaagaaggcaccgtagtcatgaatgattgttataatggctttgatgaagaagccagacggaatattcagaacttcatgcagcaacaggcagagcaggcacagaagaaacaacaggaaatgcaggcacaattccagaccggacagctacaacctggagaaacacaaaagaagaaaccagagctggcgaactggcagaaggtcatggataatggagaataccttcgtagtgcagagatgacagaagaagccaactataatatgattgacggactgatgaataacactccaaagaaaaaggataagaacgctccacggagatcggtacttaaacggctccgaaatcatcagaagaagatagccagtcaagggaaaggacagccacagcaacagaaggcgatggaagaagagatggaaaggaagaagaagtaaaaaagtcttgccggaatttttgagggcaatatataaaaaatggttgattttttctctcaaatatcatatcataatactaacaggactccccgcacctctcacgcaagtgatgtgtcccatggggagacatttttatttttggagaaataatggtgaatacaagtgaaactaaaaatgaaaagttgcaaaataatgaagcaactgtacaggtaatgaaacaaccgaaaacctttgctcaacaagtcgaaattattaaagaaaagggttttattatagataatgatacagaatgtatcggatttttaaaacaggcgaattattatagattatctgcttatttccttccgtttagaaaaaaggatgggacgtattttttaaatataaactttcacagaattcaaagaatctatgaatttgacagtagattgcgtggtgtattatttaattatatagaaaaagttgaattatatttaagaacgcaattagcctattacagtggacatgttcatggggctttaggatatatggatggggctatttacaatgacaggcacaatcatgaaaagttcgtgaaactgttaaatgtatgtatagaggaaaataaaagtacatcagtagttcagcaccataaagaaaagtatggcggaaattttcctatatgggttattgttgaatttttttcaatgggaatgttgtcctacttttatgcggatttgcagtctggtgaccagaaatatttagcaaaagaattatatggtacatcagtggcctgtttaaaaagctggttacgttgcatcactgatttaagaaaccgttgtgcacattattcaaggctgtattattggtcatttcccgcattacccaaaatgccaagggaattagaaatgtcaccaaacagaaaattgttttcacaaatacttgtattaaaattattatatccaaataaaaaagaatggatcaacaaagtcttgatagaattaaaagctattgtagaagaatatgagaatgatatatcattgagacatatagggtttccagaagattggtatgagcagttagaaaaatagagacatattataagggacagaggagtaatctgtccctttttttaatatgaactataaatttggctcttttctaccctgtagttgctgctcacgattcttcccaagaatcatatcaatattcgcagacacagtgcgaagttcccgttcataatcccgatgattagaaaaatcttcacgctgtctatccctcaattcaacaagtcggtccttttcagcatagagagatttcatggaaggtaatttattcccgccagatttttctttgagtgttcggagggctgtgtcatacagggaaagttcagcccggtgttcttcagaaaatttctgtttgtttcggcttttacgataatcggcgtacacatttttatatgccagatattgtccggtaaaatgaatctgctcattcacatctttaagttgctgttcagtatcttttaaagattttctggaagcactggtctggtctgaagcctgatcgagtgctgcatggaaatcatcaagagaatcatagccatgttcctgtatgtaggcaacagtctgagccatctgctttaaattggtgagctttactttttgagcataggcttcgctctgctgtgctttaatacaggtttgcagatctatgacaagacggagatctgattttatgaaaatgaacggtgctggtatagcagaagtatcggagaaaggaacggttggtaaatttgtggaagtattcggagactgctgttccagaatttcttctttctgttctttatgggattttgtgttttcctcaaatgctttcaagagaaaatcttctgtgtatctggttccaagattccttccagtgatatatttttttctgccaggatgaagatagctgtagcggtttcgactgatcttgaagatgatgtgatatttttcatcaaggatttttgaaaattcctctggtgatctggcggtacttgcagcatcatcaatcgcatctcggagaaattgtttctctgtctggtaacgagtttcctttggtgtgattccatcttctttcattttctgatttagcttatctaatttttcttgtccccggcgttgtgcccagtattctttttcggtgatttttctttcagcaggagtgagcagattaacttggtgcagcccttcttttttgcacatatccatgacttcctgttttagatgggcaagataggcagcacttagatgatgcttataaccggcttttgcttcacagtcaaattccatatagggttcttgtggtatatcatatttacggagactgttaattacgatatgcacatggatgtttccacttttgttatgaccgtcggtatgagtacagactaaagcctgatgaccgggaaagtttttctttgcaaaagtcaatccgagttgctgggcacgttcaccggtcaatccacattcatccctgtcttttgggtcgaagctgatgatatagtgatgggattttatttcattgaagtttttgttcttgtgatagtagctgttcagttcctgacattcagatgcaaaagagaatggatcacagttcagaccgtccagataatattcttctctcagtatcatatgcccttcttcatcaagaatcggtttttgtgtatactcgttgtgctggaagataagatatcgttccgattctccatagtcagagtttttgtttgcgatatgtttaattactgccacgaaaatcacctgccattttcatcactttatatttcatttcataaatatcccggagagactttcggatttcatttctcatttcagaagagaggattccaccctgattaaaatatcgggcaatctgatttaggttgctgccaattttaccaaactcgctaataagtttttttatttcgggaacatctgcggtaatttcgtatttgatgatgactttctggttgaccaaggcatttcggataaaatcagaaaccgtcatgctgttagccttggctctttctgcaagaagatcatattcagtttcattcatgcgtaaatgcacatctttagtttttgcaagagtttcctctttcttaggtcttgtcattgataacttcctttcttcgtagtagtggtttcataagaaaatccaaattttgcggcctgctgggaaagtaagtgatgaaaaattatcgcactgtgaccatgtaaatggaaactaatacacatatctgtgattgtggtcgagggtatggggaaacgaaatccccatcaagttgcaagtcgccaagaacccggaaaggggttattgtgctacattgcgaaacttgctctaagaaagtgacggcttcctctgtgtgggcttttgctgatacctccggtgggcggggcgtggattctgccagctatgcggcgggatttctccctctattacttactacgcacggcaaggcaaatctggcaaagttccccggaatttcttttcgtgttttcgtaacagaatttgacaaaaacggaagaatcagttccgttttgcagtgatatacggacggtttcaaaaaatgccaaactttccggcaattatttttccccttactacctactacgggaaaaaagaaaatttaggcaatgttttccaaaagtatttgaattattttattgcggtgcaaaatccggcttggttttgggcgcaaaaaaacaggaaaccttttcttgatttcctgtctttggctgccgctgatgggcggcggttattctgttatcattccccggaagcaaacttgtagcccacgcctaaaacggtctttatgtaagtgggcttgccgctgtccgactctatctttttccgtagattgcatatcacatttgccacgtttgactggcagctttcgctttccaggctccacacggcttcaaagatttgcgcctttgtgaataccctccccggactggtggcaaggcagcagagtgcgccgtactctaaacgtgtgaggggaatgtctgtgccgttttttaatacccggcgttggtgcaattttatttccaatcccggaaaagtaagtacgggggagtggggcggctgcatggcttccagcggtatcatatcagcaagggcggctatggctttctcaaccgctttttcttctgtgtcgttaaatataagcatgactatttttgcgacaaatctcacctcctgttaggtaggctgtccgtcaaagcggaactggaacagggcagcgataagccgccgtttaatgttgtcctctgtgtccttgttgacctgtccgttttcaagggaagcaagccggattcgcttgctgtaatgccgcaaaacctcgtcaatggcttccggctctccgctggtcgcccggacaatggtttcatacggtacaagtttaggattcctcatggaaaagcacctccatttcttcatgcagcatttgcaaggcactgtgtatgtgatgccacgccgtactccggcagcgtccgtacagttccccgatttcctgctgtgtgtaacgcccgaaaaaataaaggtaaatgatttccctctttttctctggcagagaggacagggcttcggcaagatttccatttgtgaggataaccctctgaccgcatatcgtaacagggtattgcttgtaagggtctatgaaatatgtgtctgacgtacaaaatggataaaacttttcttctgtgagatattcaaaggatatttccctttgccgccgtttatccctgtcacgccatgcgttgattgctgcatagtgtatgacaactctgcaaaaggcattaaaggtgtactcgatatgctccttatatgcttctgtgcaaggcataaatagttccccctttctcccacataatacggcgtatggtttataagacacttgttatttcaaggtttctactgtgaatgaagcagaattgcccgaattattatcccgtaaaagtttttgtgcttccgcttcggaaatttccttaatctccataactccattttcactattttcagcaatggaaagatatatactgccactgttattaaaatagatgatgggttttttagtatcaatgaatataccaattatctggtcgttgtagtaccaatacccatcttttgggtgataaactatgccataggattcataatcttggagcgtattcatgttttctgtcttatctccagattccatgctgtaagattcatgatttctaatcatatctccattttctgtagaagtgccagcgggcattgatttaagtcctgaattttcatacttttctgtatgcctgtcataaacttcttttgtgcattcccgaataccaataagtttatcgtttgtatcccgttccgcttcaatatccactgttcccgtaaagaaattggtaaaacttgcgccgcccactgggtcattaaaaaatcggacaacatttcccttgtaagtgtagcacttgctattcttatcataaatcaatccatattcttcatatatcccatagtcaatattaccgccgggcagttctgccgccgtatcgtaatctgaagcattctcggaagcatgtattggtttgtactcctgttcttcaaaaattggattattattagcttgggcggaagttgcaaatgctgtagctaccccgacaacaatcagacacgccagtaccagcgaaaaaatagttgttttttttgttttcataatagcagttatcctttcttcgatagcatttttactaaagctgttacaaaatggcaatagcccacttttcgttgcttccatgttgataagcattagcgaataggcagattttgatttttctccaaattgtcgtatgacgctttcatcacaagccagttctatatcacggttaaaaagaatatacatcacccacacaaaggggttgaaccaatgaatacaaagggcaagtgtcgcaatcagctttgttacagtatcatagcgataaatatgcacatattcatgtgagaggacatattgcagttgtttttcatttttccagtccatttttttcggcaccaaaataacaggacggaaaatgccataagttaatggggcggaaatcctatcagattgctttaccaaaattggacgtttcaatgggcgttccgccagccacttttctacataatggttgtggacgggtaaagctgtccgaaattcaatcagacaacgcaaataggatattacaaaaaacaatgcgataagtattattcctgcacaccatacaataaaccacatggaaacagatgataaaatattctctggcggctgttctgctccctgtgtcgtaacaaacagcccttgcatagtgggaatgttgtaatctgttccagcttccggcaatgttgtagaagatatgctatgagttaccaacgtataaacactaaacattgacggaatcgaaaacgggataagcagtcttaatatcaccaattcccataaaacaagaaaagtctttttcggcagtttattgattgccaccgcacggataatcactaccgcagtaatgaaagcagcccccgaaaagctcatttgcagtaaattcatttacaccacctcattccaaatcttccacaatctgcttgagcttctgaatctgttcagcggaaagcttttttctgcctaacagggctgcaaacagtttgtcaactgaaccgtcataaatcttgtcaaccaattcttttgtttccgcttcctgtacttcttctttgggaataagggcatggcacatgaaattaggctcggaacgttcaatcgccccttttttgatacacctttttatcagtgtgtaggtagtattcatgttccagccaatttcttttttcagaacgtcggatatgtgttttgcagtggtgtcgccctcgttccaaagcacacacattactttcaattctgaatcgaaaagtttaatatccatttgtttcctcctttccacaagaccgcagtagtttctgcttgattacacattacacctttcttaatcggttgtcaacactaccgcagtagtgttaagaaaaaattcataatttattttcttgaatagataatgaaatgagagggcttccgcagcagtcggcactgtgcgtaatgtgcataacttgctatcttatggagttgtgggaaagtccgtttgcagaatgtgggaaagctgctctttagcttttccatgttctgtgaacggacttttccataacggaatagcaagttatacacatttccatggtgcttgtcgtttgctctttggttcggaatagtgtggtgctggcggtctatctcttgttttcggttgtttgcttctttactgtacatgagcatttggttaaggtatataactcactcaataaaggatatttttttaatacttcctgatactgtttgacagtgattgttccaatatcctcgagttttttataaaccagctggcataaggatttcctttgcacatattcagaatgcggcttttctgtttcattctgttcatgcattcgtgttctttctttttgcataaacattcgtaacgaagctacactgccagtatatccctttttacaaataatatcatgtatttggggatacgttaatccctggctcctgagttttattacctcgttctcatatggagctaattttcctggaattcgaacattatagtgaccatttgtaactgaaaaatcaggatttaaataattttgtatagtcttatgggcacggtgcatctgagatgcaatctgctcaatcggatatcctgccaaagccatttctcttgcttcttttatttcctgttctttttgttttattgccagctggtgttgccgttccctggcaatttccttgctttctggaatctggtcttctggaatcacaagatatttttggattgttttaggtgatgaatgtaacaataatgctatatccgatatggtcagtccttccctgcgtttttcatgggcgaattttatacgcaatgaccggtttgcagtgttatataatgctttcatttcatccgtaacgctttctgttaatggtatttcaatcttaatatgaaacagctttcagaaaaaatagcaaagtatgttataaaaactggtgttgtttccccggaattatatgtagtatatcaatatggctttcagattggacttgagatgctatgctgtttcgtaacttgtttgagtatagcaatgtatatgcatatgattccggaattcgcaatatttacggggatttttatgttgctacgtacttatgcaggtggcgtgcatcttaacagttttggatcatgttttatatgttcagtcactgtacagacaatagcaatgtattttaacagtaaatataaatttacggtaggtacagcatggcttcttatattagtaagtgcgatattgatattgaaagctgcaccagtagagtgtatcaatcgagaacttgatgatgctgaaaaagaacactgcaaaaaagtaaccatgaaagtcttaattgctgttattgtatttgctggttgttgtacacttgcaggaataccagatatactttccttagttgcactgacttcctttataattttaatctctcagtatgttggtattttgaaatataaaattgaaaagagcaagaataagcggagatgataaaaattgtttccgctttttttattatatggaatggaggaagaaaattatttttgaatattagattatttatatgaaaacgtccaatggatttcaatccataaggacgttttttgtatatcataagaacttttttatagagtttttcttttaaacccgaacaatgggggcttcccaatcgggataagggtgaaagggaaaaagacctttgctcatatctcatggtcgggaaggaggtgaactctatggagcaatcttcttcctacgatgagaaaacggtaatgcaccagtttgatcgaaaatgcaaattggcattaaagggcgaaatagtggattatgaaaggcatttagcttatcttagaaaacacgaaactttgttttcagaattatctgaacaagagatggagagcctttctatatttgatgaatatgaattggaaaaaagctattttcgggcaggcggttatgatgtagaggtaaaaaatgctctattggcagaagcattaactgcactgacagagagaaaaagggacattattcttttgtcatactttatggaaatgaatgatgcggatatagcaagaaaactgaaccttgtaagaagtacggtacatgagcatcgtacacgatcgcttgaaatattaaagattatgctggaggaaaatgcaggtgaaaacggaagaaaaaaacgtaaataataaaaaattgataccgttttgggtaatcgaaagagcattggagggtgacattcaggcgataaataaaattctgaaacattatgaaggatatattgcaaaattatcggttagaaaaatgtatgatgaatatggctgtgttcattattgtgtagatgaaacacttcgcagacgtctggaaacaaaattgataaaaacaattattggatttaaaatagttcgctaaaaaacatttgaaagcatccctttctgctgaaaaagctatttagcgttgttttgtaccttgaaaatttaatatttatcctgcaggacagatgaaacagaggagctggacagcagatacgccaagactgtctgcattataactttgcgacatcgtgacgcaaagtgaaaatgttgtaaacgaagaaatatcaaaatgatattgaagtaaaggcacgagcgataaatatttgactgtgatcaggaagtgggacttttgtggcgaagatactgtttctgataatgatacttccgggaaagctgcccggtctgaaaagatggtgaaataccaatgaggctgttacccgacagctacctgcaggattatctataaataaataaggaagggaaaatgaacagtacaaaattattaagatatagtatgcagctatccatgctaaagcaacttagatcattaaaacttatcaatgaaaatgaatatcgcttaatagagaaaaaactaaaaaaagattatggtgtaatttccaatattactgcttgactagtacagagttgcgttgtagaataatattaacactacgataggaatacataagaaaggaccggtgaaatggaagttgaaatcattaaagcgaacagttctgatgaagatatttctaatggaagaaggattgacagattaagagttgccgcatattgtcgtgttagtactgatgatgaagatcagattaaaagctataattcaatggtcaggtattatactgatttgattaaaagtaataaacagtgggtatttgccggagtctttgcagataaagctatcacaggaacgaaaacagataaacgtgaagaatttcagttactgattcaggaatgcctttcaggaaatattgatatggtaattgcaaagagtattccacgatttgcaagaaatactttagacacattaaaatatgtaagaatgctaagagaaaggaatatagcagtatattttgaggttgaaaaaattaataccttaaaggatggggaatttttactgactattttaagttctgttgcacagcaagaggtggaaaatacatctgcatatgtaaaaaaaggcttaaagatgaaaatgaaacgaggagaactcgttggatttcagggatgcttaggttatgattatgatgtggtgactaaatcgctttctgttaatgaagaaggtgcggaaacagttcgatacatatttgatagatatgttgcaggagctggaagtacgatgattgcaagggaattaaacgaacagggaatcccaaccattaagggaaatccatggacctcttccagtgtgatgggaattattaataatgaaaaatataaaggagatattttattaggaaagacttttacagtagatccaatatcaaagagaaggttggaaaatcttggtgaagaagataggttttatataaagaaccatcatgaagcaattatatcagaggaaacttttgcaagagcccaggaaatacgagaacgtcgtaatggaggacgtaaaaagggagttgcccctgggaaaagagaaaaattcagcagacagtatgcatttagctgtatgttggagtgtggattttgtggtgcgaatttatcaaggcgaaggtggcatagcagctcaaaatatacaaaaactatttggcaatgtgtggaatcaacgaagcatggtaaaaggttttgcccagacagtaaaggaattccagagcaggttatagaggatgcttttattgaatcttaccgcatgttatgtatggatcataaagacgtgttggaggaatttattaagagagttgagaaaactttattggaagattcgatagaagataaaattgaaaagcttaatagaagcgtttataatattcaatacaagagaaaaaagttgctggaaaattatttagaaggtgttgtggctaaagacatttatgaggaaacagatatgggatatgaaaagaaattgtctgaagcaaaatcacagctgagtatgttggaacagcaatatgacaatgagggaagcttacaaagaagacttgcagattttaagaaggcattgtcaaaaaatcaagtattagaagaatttgacagaggaatatttgaaagtatcatcgaaaaagttattgtcggtggttacgatgaaaatggagagaaagatccctataaaattattttcatatataaaacaggattcaaaaatgaaattggaaacgcaaaagaacgatttgggaagaaatcaaaagcagtagaaacagtgaaagaaatgtgttcccatatcgtagacgaggtaaaggatgtgtgttcttatgttagtgacaacacatgttgaaactgtcgcatgtttgaaaaaggtaaaatagtaaaagcttttgaaacaaaaatgataaattggaactttatggggagatttcaatgaaaatccatattataggaggaagcggttctggaaaaacttatctggcagacaaattatcaaaagaatatggtattacacattatgatttagatgaactgcaatgggataataaagcagattcttatggggtaaaaagaaatgcagaagaacgacaggaaatattggaagatattcttgaaaatgagcaatggattatagaaggtgtttattataaatggtgtaaacagtgctttgcagatgcagataagatttatttattgcaagttccaagacgagtttatatttatagaatcgtgaaacgatttttgaaaagaaaacttggattagaaaaaggaaaaaaagaaacgataaggtcgcttattcatttaatcaaatgggcggatatatatgaaaaaaatgatatgattgagataaagaaaattttagaacgatataaggataaggtgatgataatatgaacttaacaagaaccagttgttttttaagtctgattttacgccacaagccagaaaccattggtatcagtctggatgaacatggctgggcgaatgtggatgaattgattgagggcatttcaaaaacaagagaattcaatatggatattttagaagaaattgtccggacagatgagaaagagagatattcttttaatgaggacaagactttaattcgggcgaatcagggtcattccattccagtggacgttgaattagaaaaggtagaacctccagaggaattatggcatggaacaggtgaaaagtatgtttcttcgattgatgagattggtctgattcgcaaaagcagattgtatgtgcatttatcaaaggataaagaaactgcggttaaagttggaagcagacatggaaaaccagtgatttatactgtaaaggcaagagaaatgtatcaggatggatatgagttcttcttatcaaaaaacggagtgtggcttacaaaagaagtaccggtgaagtatttggaaaaaatagtaaaagaataaataataaggacagagaaaatggttaaaaaaccagaaaactctgtccttattttatttgcgatattgttcaataaatatataaaataaaccaatgaaatcagaagaaatttataatataattcaagaaaaagaaggagagtgagtaaatgaagtttgatattatgaatgcaaatgtaaaaatagaaaactctcaatatgggaaaaccctttccatatatgttgatagcaagaataaagtgaatcaattaatgataaagctggcagatgcaggatttgttgttgattatgagccacgttatgaaatgcagaattatgagggatgttttctatacgaagatggaaattcaattaaagtttgttacaaattgtagaggagagaatgatatggaatttaattggttaaacaaaagtgaaatggaagttgaagaaaataaaattaagatatatgcaccaaaagaaagtgatttcttttgcaataatggagcagtgtcagaagagggaattacaccggaatctttgagtaatgctccattctattatacagaagtagaaggcgattttgtattaagagtcaaagtgtcccatgattttaaagatacctatgattctgcgtctctgatggtaatggaggatatggagaattgggcaaaaagctgttttgaaaaaacagattttgatactcatgcggcagttagtgtggtcactaaaaatggtatgtctgatgatgcgaatggatgtaatatgattggaaatagtgtttggcttcagatttgcagagtagataattcttatgcttttcattattccgaagatggagaaacttattatatgaccagattttttaacctgtcaggacagaaaaaaattaaagtgggattactggcacaagcacctcagggaaatggaggaattcgtacctatgaaaatctttcaattgaaaaaagaacagtaaagaatataagatttggaaaataaaaaacgatagggatatttaaaattataaatttttattaaaatattagcaattagcaaaaattttagaatctaatattttaaaatagacgaaaaaagtaccggaaaagaaggacaaaagctccttttttatccggtactttttgttgtcatattatctattagttcgtttatagtttactaaaaataaaatatacttgactttttatcggataaatgataccttagagaaaagaaaagccggaggtgaattacacgtgtcaaagaatattgctattaaagtagcaagagcagaaaaagatatgacacaaaaagcattagcggaagcagttggggtttcaaggcagacgataaatgccattgaaaaaggagaatacaatccgacgattaaattatgtcgaaaaatctgccgtgtgttagaaaaaggtttagatgatttgttttgggaggatgaggattatgaagaagaataaaagtaatctggatgaaagacaggaattaaagcttcttaaaattgaacataatggatgctggtttgctttttggggattgttagctgtgatgttggtgcagctgcttttaggaaataacgatgcaaaaaatcttgcaggggaatggattgtgtttatgagtttatgtgtctatcttttgaccgcttgtattaaaaatggtatctgggacagaagattaaaaccgacactgaaaacaaatacgattgccagtttgattgcaggtattctgaccggaattgcctggttcatcatttcttaccgcaactatcataaatttgcaggggctgttgcgacaggaagcattatgtttctttgtgtaggtggtttgtgctttgccggattaacagtattttctggagtctataaaaagagagtgaaaaaactggaagaagaatctgaggaataaatcataccagaaaatatgatagctagaaacaaataccattcatcgtggaaaggggataaaagccatttttcacggtgtttttttgtctgaatttttgctataatgcgagttgaaatcgtatcaaaaatttaagaagggaatttaaaatgaaactagaaaaagacagtattttttacagaaaactatggagtctgatgattccaattgtactgcaaaacctgatgcttgcaatggtcgcagtagccgatgcgtttatgcttgggggaatgaaccagaattatatgtctgcggtttcactggcaacacagattcagtttatccaaaacatgtttctggcagcagcaacagcaagtcttggaattttgggggcacagtactggggaaagggagatatcaaaaccttagatgatattttctgtatggcacttcggctttgtggcatggtatccgttatattttttattggatgtgtattctttggaaagtatctgatgttggtttttacgaatgaatctgtactgattgggtatggtgtgagctatctgaaaattgcaggttgttcttatctgttaaccggaatttcgcagtgttatcttgtcattatgaaaacaagtgaacatgcaaagacaacggcaattatcagttcatttaccgtttgtgtaaatattattttaaactggatatttatctatggtgcatttggcttagaagcaatgggagtaaaaggtgcagcacttgcgaccttagtggcacgtattttagaactgggctgttcgattgtgatttcttataaagacggctacattcatccggatatgaagcggttgttttatcgaaataaacagcttgcaaaagattttcaaaaatgtgccctgccgcttcttggtgcgtgtttgttctgggggattggatttacgtcttattcatcctttatgggacatctgggtgttaatgcggcagcagcaaactctgtggctgcggttgtgcgtgatattatctgctgttttagtgcgggtatttcaagtgcagcaggaattatggttggaaatgaactgggagccggaaatttaaaacgaggaaaattatatggaatccgtttattaaaaatttcactggtctgtggtgtgatggcttcccttttgatgttggtgactgcaccgattattctgcatttcgtgaatctgactccacaggcagcaggatatttaaaaggtatgtttggagtgattgccttttacatgatagggcgttcggtcaatgatgtcacgattaatggaatctttggagcaggtggagacacgatgtttgatatgtacagtcttgcagtatgcatgtggtgccttgcaattccgcttgctgcacttggtacttactattttcactggccagtcgtagttgtgtatgcgtgtacctgtattgacgaagttgggaaacttccgtgggtatttttgcattttagaaaatataaatgggtgaaggatttgacacattaatttagaggtgattaagatgaaaacacgagaagagattttagcttatggattaacatttgcggatacttatgtggatacgccgttttctgatacaaactggcagcttgtacgggtaaagcaaagcaaaaaagcatttttgtggacttatgagaaagatggttttttgaatttaaatgtaaaagcagacccggagtggcgtgatttctggagaagcacttatgagtctgtaattccgggatatcatcaaaacaaagaacattggaatacgattattttagatggtagtattccggatgaagatgtaaagcgtatgattgcagaaagttatgatttggtaacggacagtccgacaaaacgaatttacgaagcagtgaaaaaaattcctaaaggacatgtggcaacgtatggacagattgcagagatggcaggaaatccgagaatgtcaagagctgtgggaaatgccttacataaaaatccagacccacttcatattccttgttttcgagtagtgaattccaaaggggagcttgcaggtgcatttgcatttggcggaggaaaagcacaggcagaactcctaagagaagatggagttgaagtcgtggatggaaaagtggatttagagaaatatggaatgaaatagtttaagaaatggtggcagatgtcgtctgagatatatttatagaaaatagggtaaaaataaaaaggactttagctgaaaaaaattttcggttagagtcctttttttacaagaaaagacagttcgatatggtatgattgtaggaaaaaataagatagaaaaaagaataattgaaagtgagtagaaagaagaaaagaatgaagtcttggaaacaaaatccttcagaaaagaaaactcaaaatcaattagaaaacagagtcgaaaaagaaacaaaagaaaatcagtttaatcgtgcagaaactatttttttaaacagtatttcacatgatataagaacaccattaaatataattatcggatatacggcgcttgcatctactcatgttaatgaggcgcaggaggtaaaaaaatatctatcgaaaatagagacagcaagcaatcatttactgttattaataaatgatgttctggatatgagtcatattgaaagcggaacgctaaagcttgaacacgcaccagtgtatttaccggatgtgctggaaaatttaaaagcaattattcagacagatagttctgcgaaacagctgaaattttgtgcagataccaaaaatatggtgcataaaaatgttattacggataaacttagattaaatcaggtattattaaatatcttggaaaatgcagtaaagtatacaagacctggaggaaaaatttattttcaaattcaggaattaaaaggacaagagccgggatttgcaaaatatgaatttcgtgtaaaagataccggaattggtatgagtgaagaatttatagcacatatatttgaaccgtttaccagagaacagacctctacagtcagcgggattgaaggaatgggacttggaatggcgattgtaaaaaagattgtagacaggatgggtggtactattgcggtaaaaagcagacaggggaaagggacagaagttacggtaatattgccatttaaagtcaatagtcaggtggtagaatgtgaaacgaaggtactcaaaaaaacaggtcagatgaaaatgcttagtgagagaagaaattctgaaaatctgcttaagggaaagaagattcttttggccgaggataatgaattgaatcgggaaattgcagtagaactgctaaaagaagaagggtttattttagatacagcagaagatggaacaatagcggtagaaaaaatgagaactgcaaaaccaggtcagtatgatttgattttgatggatattcaaatgccgattatggatggatatgaagcaacccgccaaatccgaaaatcagaaaatccagaaattgcaaagataccaattatagcaataacagcaaatgcatttgaagaggatagacaaaaagcattggaggctggaatgaatgaacatgtatcaaaaccgattgatttggaaaggctgttggaggttttaaagaacgtgctgaaataacaaaagagaaagaaagctttggagcaaaaaagatagttccagagctttctttgtttttataatgagaactaaaaagtaaaggaatcctcgtatttgaaagataaaagtggcataatagagatatataaataatctagatatttatagaatgtagtaggaagatttaccgtattaaataaggaggaacaaagtatgtttattaatttttcaaatcatccaagtaaggcatggggaaaaacacagttaaatgcagcaatggaatatggtgaggtgatagatattccatttccagcagttaatccgtattcaaataaggaagaaatttataaaatttgtgaagagtatgtggcaaagattatgaatttaaatccgtcttgtgtgttatgtcagggtgagttttgtgtcgcttatggagtaatttcagcactgaaaaagtttggagtaaaggtagttgcagcttgtagtgagagaaaatctgtggagcgaaaggtaggagataatgtagagaaaacttctagtttttcattcgtacagtttcgggaatatgagtaaattttaagaatggaaacgagattaaaaaagtaaagactataagaagggataaagtttttttacagaggaaagataaactatttaaaagagtggtaaaattaaaaaaaataatttaaaataaatagtagcaacatgagatgtagtcagctgcctctgacctagaattaatgttttaaagaggttagaacttgtaaaagttcaagttgactagcctaagtgtcttgaacactacgttatttctgttatcacacctgcaaatgataccctagtttgcagctctgtgcaggctctgtaaacaactctgtgaggtaggagtagtcaacctgaagtctccgattacgggaagcagttctaacattggcgaagggtaacaaactttcttaaatagaaaggtgcaggacctgagggtagctgcaaaaggtacatattatgcgagtatttgtatttaatatgcgaggcgaacctttaatgccgtgtacgcaaagaaaagcccgcctcttattaaaagcaggcaaagctaaaatttataagtataatccatttactattcaattaaagtatgcaactggtgagaacaagcaggaatgtcatgtcggaatcgacactggttctaagcatattggtcttgctgtgacctctgaaaataaggttttatttaagggcgaagtagagcttcgtcaggatgtaaaatcaaaaattgatacaaaacgaatctatcgcagaagtaggcgaaatcgtaagactcgatatcgtagatgtagatttttgaatcgtaaacggtttggcaagtggcttccgcctagtttacaaaatcgtattaatcatacatttaaatggattgataaactatgttcttttataccagaatcaattcttcatattgaagttggcaaatttgatattgctaagatgattaatccagaggttcatagtatggattattcgcaaggtcaaacttatggatatcaaggagaacgatattttatttttgcaagagataactatacatgtcaggtatgtggagaaaggaataagccattacaaacacatcatattatttatgtatcaaatggtggcacgaatcgtgtcgataatcaaatcacagtttgtaaaaattgtcataatagtacgaatcataagaatggagggattttttataaatggcagaaggaacacaagaaagttaagcagtataaagaaccaccatttatgaatgtacttagacaacaaattcttaatcaatatccacaggctcttattacatacggttttgaaactactattaaacgtaaaaatattggtttggagaaaacgcattataatgatgcaattgttattagtggaatttctactatttctgagaatttagatgaatggcttcttattaagcaatttcgtaagaaaaaacgttcactacacgaaggagtgcctcgtaagggaagaaaagaaccgaatcgtatacaaaagcgtaatagcaaaaatactccatattatcgtggattctatctgaatgataaggtgagtgtatttggaaagagcggatatattactggatttaccaatagtggagcttatgtcaagggcgtagatggtgaatatattgttttaccgaataaatcttataagcgggtaaatattgcaagtttgaaatttatctgccacaataataattggcagtatattacaaaaaatgccgtgtgattcaagatttattttatcatcgttatggagtatgaaattctaaatagaaaaggataaaagaaaggaaattcattatggattatgccacattaagtaatgaagagggttatacggtttttgaatttgaaaattatagaataagatttaaagcaccgtattccttagaacattatatttctgttaaagaatgggataatggataccttgttgtgatggcaaaatatagtcataataatgaatacgaagaggaatatattgatttaaatccaatattagaaaatttatatattccctccaatgaatttttgagtaaaataaaagaagtaagaatacaaaacacttaagaaaagaggctttacaatgaacaaacacatagaaaaagcaatacagcttagaaatgcaactccaatggtcaacaattgttctcagaccatccttcgggtttatgctgaggagcttggtttggatgaaaatcttgcagcaggaattgccggcaattttggtggcggaatgaaatgcggaagtacctgtggggcaatcacagcaggacttatgatacttggagcaaagggaatcgaatctccatttgcggtaaatgaatttcgcagacgaattgctgagaaacatgatggaatgacagactgtgcagaacttttaaaagccaatgcacagaaaggcggagcaaagaagccgcactgtgataacatgatttttgaagcaattgagctgatcgatgaattaacaaaagaagcagagtgatttggttacgagcaaatagcggagcaaattgcgaatatccgccggattaagagtaaagtaattttagaaagaaaagtaaagaacagggagaatgagtccaatgaagtatacgaaatttggtaaaacaggaattgaagtttctaagatgtgtcttggcacatggggcattggtggtgcaggatgggacaattattcagatgagagccgtatggatgcaattaaagcagctttagattgtggtattaattttatcgacacagcaccagcctataatgcaggaaaagcagaacagtatgtaggagaaactctgcataaattgggtgcgagaaaagaagttgtgatttctacgaaatgtggaaatgaatttattgacggaaaatatgtccgttgtggttcagctgataaaatcttaagagaatgtgatgagtctttgcagaatttaaagacagactatattgatgtctatctggtgcactggccagacccaaatgttccgatggaagagacaatggacgcattaaatcacttaaaaaaacagggaaagattttacatgccggagtttctaattttacaaaggaacagatggaagaagcaaaccaatattgtgaaatcgaagcctatcagccacagttttccatggtagaccgggataatgaagaattaatccgctgggcgcatgcacaggacatgggagttatgacttatggaacattaggtggtggaattttaaccggaaaatatcgtgagttaaaaacgtatgaagcaaacgataatcgaaatagattctatccatatttcagagaaccactattctcaaaagcaatgaaattgttatctgttatggatgaaatcagtaaagagagaaatgtaccgcttgcacagattgcattaaactggaccttgaaaaaagaaattatttcttcctgcatcataggttcacagagtcgtgataagatagaggcaaactgcaaagtattcgactgggaattaagtgcagaagaaatgcagatattagataaagcgattgaggaatattcgagagcgtaaatagaaaaaagagcggggaacaaagaaaacaatggaaaagaaaaagtttcaattagggaaaaagaagcaggatgaggttgttttaggaaagaaagagaaaaagaaatttatgactccgaaaaaatggaatgttgtattaggagttcttgcggtatttttctttttagcagctgtaggcaattcaggtaatgccacaaatgctgaaaaatgggaaaaatcatataacgaagcaaccaaatcgaatgatgaaattaaaaagcaaaatgaagatttacaggcaaaattggacaagcttcaagcggattatgattcactttctgaacaggcaaaggcgcaggaagaccaaaaaagtcagatagacagcttgactcagaaacagaaggaacttgaaaaacagtataatgatttaaaaacaaaaaatgatgcagcaaataagcagaatgaagaactgaaaaaacagagtgacgatttaaagaaacaaaatgaagatttgcaatcacaaaacagctcccttcagtctcagcttgcaagtgcacaaagcagtgccaatacaaatacagcaacacaggcagtggagtcctctgctccggcagtggataattctacaccaagcactgaaatggtatggattccagcaactggacaaaaatatcataataaaccaaactgtggaaatatgaatccagatacagcaagagaagtgacaaaatcagaggcagaagcaagtggatatagtgcttgtaagaattgttatcgttagttatagaataaaaacgagttttgagttttaaaggggaaatggcaaaaaattaatttgaaaaattttttatcatttccccttaattagctaaaaatctgtagatttaaatagattcaattaaataattataccgcacaagggtaatttccacttgttgtaatattttcttttttaaatcatttatagaacaattattgtcgattatggaataatttattttgtatgtttcatttttaatttcagatctatctactaaatactgagccttttcttttgtatatttgttccttttgaggattcgtgtaatacacttttctttttctgcatttataatccatatctcattaaatatgttttcaagattgcgttgtgtcaaaaaagggatatcaaagaaacataatcctgaatatttcaattcgtgaaactgattttttatttttttacctatatagggttgaaaccattcttcgaaatttttttcttcagattgatggagttcaaagtatgagcccacatactttaaatctttttctgtaaaattatttaaatctttaccgattattttacttagtcttgagtgtactgattttgaattattaataacttgatgtgaaaaataatcataatcaattgtgaaataaccgttatcttttaatatttgcaaaacggtactttttccactacctgcagtaccagttattgcaatgtaataatgtttagctttttccaaaacatagtctccttttttctgctaattcacaaaagaaaacaactttctgattttctgttccattatatacatttgagtaagctggacaccatttacagatttttctggatgcgcaatttgaacactcactgttatagacaatttgttcgtgttctttatgaaccttttttaaatgttctagtacgtcatctatattacgattaagaatagagattcctttttttcgatataatccacaaacgtatgcttcccctttataatcaatagcaagtgagtttatccctgctctacacttccatttcacattgtctgttctttgaattaattctttccattttttagaacgtaaattgttttgttgttccagtttaacaattgctttgggagacaaacattcattcaatggagtactatcacctgatgtttttggaaaaatcacaggatcatatctgaatggaacgcctaaagagtctgccattctatcaaagtgaccatttttaattgaattatataatgttttagttgctactgttcgtatgttaaagttcagtttgctttcttttaataaaattaaagcattcataactttattgtaattgttgccatttccggtaaaaaggttataatccatttcgttcgtcccatataccgttacagaaatattatgaggtggatattgttttaataagggaataagattcttatctattaaagaggcatttgtcattaaatcaatcataaatcctttcctttttgcataaacataaatttctgaaaagaaatcataggtaagtatttctccaccagtaaaaattaatagaaaacatcctgattcatataatttatcgattatttttcgtacatcttcataaggtatatagggatttcttttgtctgaacaatagcaatgaagacaattgaagttgcatttttgtgttaattcgatacttgcaaaaaaaagcaaatcgttatttatataccatttttttatctgctcaaaattcatttactttacctctaaatagcctttgtcaattaaggttttaatcatagtttcaaaatcttttgtttttataattttctcgtccaatcctgttttcatttgatcttgtaaatagagaattgccggtttagatgcactcaatatttcgtttgtatgtatattaattagaaatgcacgatttaaacaaaatcttattgcaatgtctgaattccatgttatcatctttatctcctaaagggtgagttttaagtaaattcgtctcagtcgaagttttaatttctggctgagacgaatgctttgtgaagaagcgcagtaattctaaagaacatttatcgtcgtattgttgaatagaattatgcgccaaattatgattgtttgatttagagattaattagcagtaaacaccacttccagtatctccccaacaaccagcttgaacttctgtgttatcacgaagttcagtttctgtactgattacctcaagagtaaaatcaatattgttttccattctattgcctccttcctatgatagaatatttataatgaaattatttcattatcatttatagttgtattattaaaaaagaaatttgtattttgaagaatattcagtcgtaatatttatcatttgaatcatcatcttcatcaaaataattgtcctctccatattcttcaatgcatcgcatatcgttgtattcttctaatcctatactgctttcatcatcatcacggttaagccattcgtcgtagaattcatattcgtctcttggatccataaatttatacctctcttaaataattctctagttcgtgtaaccaacatgatgtgttatagtcacaataagcacgttgggaatggtacatatcaatgcacaatttcatggaagttacacttggtagtctaccagttctcaattcattgacgtattcttgtggaatacgaggataccatacctttcggaaacccacacagccgattttattggcaaaatggtttgaatcttgaggatcttcagagtataatgtaattggggaatatagtcgatccagatagtcaggatttgaaccttgtgtttgtcttgcaatatttgcatataagcttgatacaatgatgatatcgtaattgtaaggttctgatgcaaattcaagttgtgcacctacagcctcaggcagaaaaatattcatttcggatgagcttgtaggaattagttggctttttacagacaaaggacgcatttgccttaaaatttcatctggttttgcttcaggatttgtaagaaaatattgtcctttgcgattaacggcaaaattatcagaatttaggtagagaaaaagatcatgatttacaccgttatatttacggggtgtgtgtttgttcatttgagaattcctccaatcatttgtttgataagaggatgatagcatgtttgcaatgggaatgctatgtgtatttatgtgtatttgataagaggagaaaaatataaaatgaaaacagagctatggtatgagcgtgaatttggtccggaaaaagagcttagactttttttttctaaattattaagagagtgtttgggtatgaaaaatggttctggcgttgttaagggtattgaagaatataaagctggacggcctttttcaaatgttttcaatagaactaaaaaaggaaattatgtttttacacctacaatttgttgtgattttttggaattgacattaagaaacgagtcttttgatagagccgtgaaagtaatacaagagtggggaaatggtttagatgagtgtaatttggataaattgaaacagtgccctaatatagaaaaaaatgaaactgagatggggatttattgcaaatgcattgcagctatttatgatggaaaggattttaaagataaatgcaaagattgcccaataaaactaatatatgaaattttaccagatattgaaaacgaatatcgaactaattatgtttgtaaaaagaaaatattggaaaggtatgattcatctgttcaagaagaaagcgttagtaaaatatataatgatatacaagaatttgaaagagagtttggaaataaagaatttaatataaatgaagtttgtgaattgtttgaaaaatgtatccagtgtatggagatagaagatgtgcgtgattataaattagcatatataaaatggtacactgcaagattatgtacatggccttactttaaattatgtttattacaagccaatagatatgatgaaagggttgtttattcacttttgcaatctgcttcagttatatgtaattcaatgcagattatagaagatgagtttcaattatgttataatattgaaatggataagattatatcatatttatctcttgcatatcaaaatccatttatagtgaaatattgtgaaaaatcagaagaaattttgaacaattgtagtagacttgtaaaaatatgtccagaaagccaatatcaattagaactttatacagaaatgtggaatttagcatctcatacacagcaaaatttagataatatatataagaagaaggtacaatatttactaaaagaaaagaatttagatagggaaggtgagagatattatacttattcctatatgtataatttatgtaagtgtgaaaaaccaaaactaatattatcggcaaaggcgtatagattaagaaaagagaatttgtataatgatacaattgctatgataacggaattatttttaagtaaagctttagatgatagcgaatttgctgaatctggaaatctaactttggacattataaggataaaaggatatgatgagaataaaaaaaatagggttacagaggagtattcagttaccccaccatctgcttatcaaagaatttatggagataatatgctgattagtcgggcatctacttatcaaagaattcatgaaaatgctaggataataaaatctatagatgattatatggagcgtataaagcaggaacaggcaaacgcagatgaaaagtgagatttttaaccagaaaattcgatgaaattttgactcttgcatcgtaaaatagaacaagtaaaagaaaataaacaggcatatcagacatggggaatgatatgcctgtagtgcgttgtttgagtttacatttacttgaacgaaggattgatgtaggaagaaggtacgattgaaatgggattaacaaactatgtaagtgcaatggattgctggaagggacgtattgacagtacaacagattatgatgcatttcgctggcatcagtgggtacagccgttggatttgaatatacagacggaaaagccggagtgtggactgggttttgcttttatcggtttttgcagtgagcagggagtaaagcgtaacaaaggtcgtgtcggaactgcgcttgcaccggattttatccgtgcacagatgtcaaatcttccatgtacttttttacaggatgtcaaattatatgatgcaggaaatattttatgtgatgagatctcaatggaagaaggacagaaactgcttggcatggcagtggagaaaattttggatttagagctgtttccgattgtgcttggaggcggtcacgaaacaacttttggtcattttcaggggcatctggcagatatgaagaagaaagaaaagcctcttgatatgggaatcattaattttgatgcgcattttgatttaagaccttatgaaaatggtccgtcatccggttcgatgttccgccagattgcagatatttacaaaaaggaaaatgtgcagtatcattatcttccgttggggatacaggaacatagtaatactgtcagtttatttaaatttgcaaaagaaatcggaacagaatatattcttgcaaaggaaatccaaaattccaattatgcaacgatattagataaagtggatacctttttatatcagtgcagttcagcatatattactgtatgtaccgatgtattttcttccgcttttgcaccaggagtcagtgcaacacagtcactgggactggaccctgaagtggtacttccgattatcaaacatattttgagaacccgcagagtcagaggatttgatatctgtgaaatctctccgagatttgaccaggataatacgactgcaaatcttggtgcagtgattatatttgcggtggtaaatacgctttgtaaattaaataatctggcgattgatgtattggaataagggaaaattattaagaaagcaagagggaaaagacaatgtattatgtgccagatggaacaaaagaatgtggattttatgaatgtaaaaaatgtggaaatcgttttctttctcttcaaacgatggaaaagattccgtgtccggaatgtgaggcagaaatcgactatgaaatcggaccagatgaaagcttggaagatgttttagacactgccgtcttactggaaaaaattgaaggattagaagaagtagaaaaaatggatgcacttttaagtcttgcaattaccggaggggatgatagttggatttaagagttcgcatctgtaaattcttaaaaaaagaagtagtgctttgtgttgcttttgtgctggctgtaatttcttcttttttgattcatccggacaagaaatatatacagtatattgattttcggaccttagcaattttgttttctcttatgagtgttatggcaggattaaagttgcatggagcctttgattttgtggggcgtaagatgctggaaaaaacaaaatatctttggcaggtcattttaactttagtgcttcttactttttttggaagcatgctgattacaaatgatgtggcgttgattacctttgtaccatttacttttgtggtgtttaatttgctgggagaatcctaccgaaaaaaacaagttttatgggtagtctgtgttcagacgatcgcagcaaatcttggaagtatgctgactccccttggaaacccgcagaatctttacttatatggaaaaagcgggttgtcatttggaaggtttcttctattaatgctgccttataccttaactgcgctggcgcttctttgtagttggagttttttgctttgtgtgaaagaaaagaaaaaagtaattcaaatggagtggaagtcagaagagcaagtattttgtaactggaagaaaataagagtttatctgatattatttggaatctgtctgcttgcagtcctacatatcatggattatcgaatttcttttttgattgtgttgcttcttatctttctatgggacagaaaaagtttgaaacgagtagattattcgttattacttacgtttgttgcattttttatctttattggaaatgcaggaagaatttctgctttttcattatggctaaatcagattatagaaggacgggaggtaattgtggcagtgcttgcaagtcagattatcagcaatgttccgactgcacttttattatccggatttaccaataaaatttcccttctgattatcggaacgaatttgggtggccttggtacattaattgcatcaatggccagtttgatttcttatcgtcagattgcacaggaagaaacagaacgaaaaggaaagtattttttgatttttacaatctcaaatgttattttcttgttgatttttcttggagtatggaagatgacaggggtacagtagaaaatctgtatggaagaaggaagtgtaaaagctatgagaaaacatgcgttaattgtcggaccacgcagagttggaaaaagtacgttaattcgtaaagtaatagaaactttgaattattcggtagcaggttttgagacaaaaaaagaatcaaaaatggaggatgaaacgctgggttctcccatttatattcatacgataggagcaccgtggcattattccgaagaaaatctgttgggatattgcaaaaaccagaaaacacaaagaatcagcgatgcatttaatcgttatgcagacaagctgttacagccagtacccgagggaacgattctttgctttgatgagattggattcatggagtcaaaagaaaaggcattttgtgatgcagttttagaacgacttgacggagacattccgattcttgcagcagtaaaagataaagaaatcccttttttaaatcaagtgcgaaatcatccaaactgcaaatgcttttttattacagaagaaaacagagacaagttagtggatgaagtgcttgaatttatgaaaaatcaaatagaaaaataaatattcagaaaatggatagaaatttggcagagacaggctggatttttatccatttttgatttacaggaaattgctttctcataaaaatgattgaaaaagggctgcttattattgaggttctttttgttttttataataaaaaaataaataggtacgacaaaatatgacgtcctccattgctatgataatagcgatggaggagtagaaaaatggcgagaacagataaggctatgcgaatactttctacgcagttggaattgctgagaggagggaaagtttataaaaaatcttattgcaagaagaatgaagtcagtgcccgaacatttgacagagacattgttgaaatccgtatgtcattaagtgaatcattttccgggcaggaagtgaaatatgtaagaaatgaaaattattattatctggataaaccggatatgataaaaccgttgactgcaattgaagcatcttttttgttggaaatgataaaaacatgtcaggtacttcaaagggaagaatatgtgggaatggtagacagtattgtgaaggcaacggaattgaaccgccgtcagtcacttgaaaaaatggcagagaaatataaaaaaatggatataggggtaagcgaagatgcaatgctgaaaatgctgtgggatttattgcagtgtgttgtagaacaggataaaatcagggttcattttaaggataaaagaaaaatagaattatcaccggtctttttgtggatgtatcaagataaaatttacctgtttgcttatgagaaaaaaacattaaatgtatattctctgcatgagattgactggtttacactgcttggaagcaagtatccgagagaactgcaggagaaattttataaagtttcctgtgaacagatacataaaaggataaaaaatatagaagaattaaaagaagaggagtaagcatatcgacaggttttttttaataatgtaaaggagaatttgaatgaatgggacaaaatctgcaaaagaatatcgaaaaggagaacaattagaaattacagaagagaaaatgacagaagaaacactggaaaaaatagaagagatttttcaggaatttctcgaagggagaaatgaaaattcaaaaaagattgcagattctgtagaactttatgaaaaagaattagaagattttaatcgaagcatgagagcaggaatcacaaaagaatcgtggtttctggaaaaattacaggataaagcgaaaggactttccattgattattttggaaatattcttttggagatgaatcaaaaactggctgaatcaaacagaacaatgagcaaactgctgtttgaaacagaagaaatagatagaactaatattgagcagaagaaaaccgtaagaaaatgcaaaacaaagtggaatagttataatacgaaagaagttgcgctggaattagcaagagaagccagatgtcagcttatgttttggaatcaaaaggatgagtggctgaaaaattcacagtttttagaaaacctggcaaaaagctggtttgaacaggagataaatacaaataaaaatagtgaattaaaaaacgtcattgcagaagcattaaagaccgcagggaaagaacagcttcttccatatcaattttcacagctttcaacagagtggcttaccagaatagcctgcgtatcggtagaacatttaaaaattatatgggaaactgcaaaaggagagatggcaatgcgggaagcaacagaagaaatcgaaaagtgtattcttgtgttatattcttcttttgatttgaaaaatgtagactttctctgcttttatgcccctttgttagggagagtgacagaggatgtccttaatagaacgacagataaagaaaataaaaagaaaaaagagaaaaaatagccgaaaatgcagggcggaatattgtgaaaaagagcaaaaaaggtatactaagagatagcaagaggagtggcttttcttagaaaattataaaaggaaaaaatttttaaacaataaaaaggatggacggaatgtgtctatatcaaatgctatgattcaatcaaacgatggaggaaagccatatatgaaagaaaagaacgaaagtaaagagaaaaacaaaaccagaaacgaagataagaatgaaggtaaaattatcagagttttagaaatctataccagactgttaaacggagcggttatcaacaaagaagaagaggcagagcggtatagagtggcaaagcgaagcattcaaagagacattgattcaattcgggaatatttaagacgaaccgataataaaagcggagtatatgatttagttaactatgattacagaaaaaaagggtactgtctggaacatatttacaaagtaaaattaaaaagcagtgaaatacttgcaatctgtaaaatccttttagaaagccgttcgatgacaaaaagagagatgacagatattctggataaattaatcgaatgttgcgttccacttgagaatcaaagagtaattaaaaatttaattttaaatgaagaatttcattacatagagccacagcataaaacagtatttatcgataaaatgtggaatatcgggcaggcaattcgagaacatcagtacatagaaatcgaatacaaaaagatgaaaggaaaagaaacagtagcaagaaaactcaaaccggttgcgattatgttttcggagtattatttttatctgacggcatttattgatgataaaaaggtgcgggaagattttaatatcttagaggattcttttccaacgatttatcgaatggatcgaatccattctttgaaaatttcaaaagaaaaattcaatattccatacaaagaccgatttgaagaaggagaatttcggaaacggattcagtttatgtatggcggaccactgcagaaagtacgctttaaatacagtggaatttccgttgaagcagtgcttgaccgcctgccgactgcaaggattctgcatgaggatgaaagcggatatacgattgaggcagaagtgtttggagaggggattaagatgtggatacggagccagggagagttgataagtgaggtgagttatcggtaggagatgtagagtagttcggcagaattgattttctgttagaggaaaattgggaataagaaaaagattgaaattaaaaagcatctcaaatattagatactgtaccgcccccaaaaagttagactaaaaatttgacttttggagggcggtatttttattttggataattttcataagcggaacgaatgatttgaataattttttcaacaacggtttgtggtgaaattacttttacataatgccctagaaagagaatattgcgaaaaatttcttcttcttgaaaatgataatagtagatagtcatagtgagtttattattttgttcataacaataagtgtcataagaagaaaaaagataagtacaccggtcataagcttctctctggtttaaaatttctaactgaattggatgtgttaatttaatattagaaagttgtttttcaaaatctataataaattcatcataattcggaatgacagttccaattgaaacagaagatagatttgagagaattattttaacggggcgtttggcactaattggatagcatgagaggcaaaataaattaaattgtggtgaatattcaattttatagggatatacaatttcgttagagtaaattttaccggattcactgtgattggtaacagtgagctgccgatgctgttggactgcctggacaattgtttgaaaatgggtaataaattgtggagtaatatccaggcagctttctgtagaaaactctcgtatatctatataatgttgctggaggggataatctttaaaacttatatctttcaataaggcatcaagaagtttttgctttaactctgaatttaaaaataaatcggagttactggtttgaagtacatagtaaagccaggctttttctgcaatgcttgcccgaactggaataggaacttctctaatgggttgcagcttgttctggtcatctttatatagaagtcctgcattatgatttggaaaaacagattgatttaaaactgcatgaataaattcttcaaaggtgctttgagaagttcctaataattgatattccagttcctctggagtcagtgccagttcttcattagagatacagctgttaatgtaatttgtgagatacataaaatttttattcttatatttattaaatagtttcatattgttttaaagcctctttccagtcgaattttaatttttgtgcgagaaaaggattcgtttcggaatcaactactgcataagcaccgaagcttcgtatccagggaattaactcgcattcatcttgaacttcgacagtaaaatcaatttgtccgttctcaagtttcgttattgtcccatgacgtttggttgaaattaaatagttcgaccattttttatagttttctgttggaaaagaaaaatgtatcgttacaatagaggttgtatcatttagtgcaacattccagatattttttgtctgttccttataagtctgagtatacaagctgtctaaagtatcaggagtttcatctgattgttctaattcaaaacattcatattttctagtcacattaaattttttatcaatttgaatatcaataatagatgaaattttggccataaaaaaatttttttcatcataactgtaaccaaaaaagtactgacgcccgtattgcttatcaattaccagttttattggaagcgaatgaaataatagttcttcggagtcttgagttttataagaatattgtagtacttcttttttgtgtatcgcagttaaaatcgtccaggttacatcatcatcaattacggtttgcaggcgatgatttttataaaagaagaccggatttttttgtttgtaaaaaaaattcactttttctttaagaaaaatagaatttgaataggcttcaagtgtagatgaaagataaaaaccgggtatcgttaaaaaagtactattataaaaaaactgagtcattaactgaaggtcgtaaagttcatctgcggtcaggtttaaaaagatatcagaagataaatgatatctgatttctttagaagaatttgtttttataagaataccaatgtcagtaagttcggtcaaacgtgcacggatttgtggaggcgtaaataacttgtcattgtatttaaaatcaggaagcagttggtttgatttttttaaaatcgttaaattagagttataaatattagagataattgtaaataagtcagcaacagaaatattaccattaaattcaacggaatcaattttatcagcaggaagtttataatcaaaatgttcgtaaggattcttatcatctgcatcaataaaggtctgcataagacagaaatagaaaataatatcatcaataacataagagcaattttgataagtttcagcaagataatttacaggacagcgaaatgggtcatagattagatgaaattttttaccagaagccgtttcgataacttttggttcttgtaagtattcactattaatatagtttttaatccgtagacaggtatgataaaaagaactggtgctattaatcagttttttttccaaaaactcatctaaagacgaaatatcatataaatataagtaccgaagaatattacggattttattataatgtttgatttcattttgaaaagtatgagtgttttttgccataagttcctcccagggtattgtaggtttttttgaacgaagaaaaatatcgttgtgataagataaaattatcaaataacaaagaaaatttacttgcgaatatatctataaaaaatatatcaaaaacattttaacaaatccagagagaattattaagaggaggaacgttaaatggaaaaagagataagagataaagagaaagtagaaagagttttaggaatttatacaaaactgctggatggaataactgtaaataagcagaaagaagcagaaaagtatggggtagtaaacaggagtattcaaagagatatagataatatacgcagttatctggcaaaaacagataatgaggaaagtgtttataataatgttttatatgattataaaagaaaaggttattatttagagcatatttatgataaaaaattaaatagtaaagaaatgtttgtgatctgtaaaattctgttagcaagccgttgtttaacccaaaaagagatgtccgagattttaagcaagctgataaaaacttgtattccattagaggaccaaaaattaattacagaattaatttctaatgaggaatttcattatgtagaaccacgacataaagtcatttttgttgataatatgtgggaaattggacaagcaattcatgaccagcattatatagaaattgagtatgagaaaacgaagaatgaaaaaacgataatacgaaaggtgaaaccggcggctattttattttctgaatattatttttatatgatttcatttgcaactccagagctggaaagagagaaatttaaacgtgttgaggattctcttttagtaatttaccgtttggataaaataaaaaatttgaaagtattagaggaaagatttcaggttccttatgcagaacgatttgaagaaggagaatttcgtaagagagttcaatttatgcaaaatggtccacttcagaaagtaagatttaaatacaatggcaaatctgttgaagaagtattggatcggattccaacagccagagtcttacaggaaaatgaagatggggcgataattgaggcagaagtgtttggagatggaattaaaatgtggatacgaagtcagggagagttaataagtgaggtgagttataggtagtaaaaataatatgtaaaaaagattagcagatgaaaacctggtaatcttttttaacactcttgacaaattctattagttagaataaactatctttaggtagaagaggaaacaggaggaacacgcggatgtctttggatgtacttgcattggaatttaccgatatgcagctcaagtattcaaaagaaatttcagcgtttttggatagggcatcagcgtttggacaagaccggattctgatttatctatataaagaaaatgaccatattctggttggagatttgacaaatgaactgcagatgtcgaccggaagaattgcaaatattttaaaagagctggaacgaaaagggtatattctaagaattcagcaaagggaagataagagaaagtatgaagtttgccttacaaaaagtggcgaaaattacagcagggaattgtatgcggatatggttgcgaatcatagagcattgatggaacagctgggtgagacagatggagagcagctccttaagctttctgagaaagtattgcggtttagaaaaacaatggtttgtaaataaaacaggctgaaaaagcctgttaaaaaatccaaaatatcttctactgaaagataaactataaagtaaagaaataaaagaacaaaaaacataagagaagggagattagaaaatgacgctcaaagaacttgaaatcggcgagagtgctgccatcaaaaccgttggtggttcaggggcacttcgtcagcattttcttgacatgggaatgattccgggggcagaagtcacagttgtaaaacttgcaccaatgggcgacccgatggaacttcagattcatggatatgaactgacacttcgtctggcggaggcagaccagattgagattgagccgattaaaaagagaagccgtgcacacgaaggaaaagagtatttaaaaccatctgaacatccggggcttggtgaagatggaaagtatcattctaaagaaagtgaaaatcctcttccggaaggaactacattgacctatgcattagtaggaaatcagaactgtggaaaaacaactttatttaatcagttgaccggttcgaatcagcatgttggaaatttcccgggagttacggttgatagaaaagatggttcaattaaggggtattccaatacagatgtgacagatcttcctggaatttactcgatgtctccatatagcagtgaggaaattgtttcacgaaattttgtattaaatgaaaagccgaaagcaattattaacattgtggatgcgacaaatatccatagaaatctgtatttaacgatgcagttacttgagatggatgtgccgatggtcgttgccttaaatatgatggatgaagttcttggaaatcagggttccattgatgtaaatgaaatggaagctctgcttggagttccggtcattccgatttcggcagcaaaaaatgaaggggtcagtgaattagtcgaacatgcgattcatattgcaaagtatcaggaacgtccgcttcgtcaggatttttgtgataaaaatgaccatgatggtgcagtgcaccgttgtattcatgcggtgattcatttaattgaggaccatgcacaaaaagccgaaattccagtacgatttgctgcaacaaaagcaatcgaaggtgacaatctgattctggaacagctgaaattagatgaaaatgaaatggaaatgctcgaacatattgtacagcagatggagaccgagcgaggactcgatcgaagtgcggcaattgcagatatgcggtttgattttattgaacggctgtgtgagaagacagttgtaaaaccaaaagagagcaaagaacgtattcgaagtgaaaagattgataaaattctaaccggaaaatatactgcaattccatgctttatcggaattatggtattagtcttctatctgacctttaatgtaatcggagcatggcttcagggcattttggaatttggcattgataagatttcagaagcagtgggctcagcaatgactgcggcgcatgtaaacagtgcagtgcatagccttgtaatagatggcatttttaacggtgttggaagtgtattaagtttccttccgattattgtaactttatttttctttttatctttgatggaggacagcggatacattgcacgtgttgcttttgttatggataagttgttaaggaaaatcggtctttccggacgaagtatcgtgccaatgctgattggtttcggatgtaccgttccggcagttatggcaacgagaacattgacaagtgaacgtgaccgtaaaatgacgattcttttaacaccatttatgagctgtacggcaaaacttccgatttatgcattttttgtaagtgtatttttcccaaaacagggcggactcattatggcaggtttatacttgcttggcattttggttggaattctggctgcctgtctttataaaaatacgttatttaaaggcgaaccggtaccgtttgtaatggagcttccaaactatcgtctgccgggagcaaagaatgtaggacagcttttatgggaaaaagcgaaagatttcttacaaagagcattttcggttattctgcttgcaacaattgtagtttggttcttgcagagtttcgatttacatttaaatatggtaaaagattccgcagacagtatacttgctatagcagcaggatttttggttccgattttcaaaccggttggtcttggagactggaaaatctgtactgcattaatcagtggatttatggcaaaagaaagtgtggtatcaaccttagaagtgctctttgtaggcggaatcgcaggtgtgctttctccactttccgcagcgtctcttctggtatttagtctgctgtatacgccatgtgtagcggcaatcgcatctattcgtcgtgaacttggtggaaaatgggcggttggagttgtattctggcaatgtgcagtggcatggatttgtgccctgattatgcatttaattggacttggaattggattttaataagtaaaaataaaagatgaaatgctttaaatgtcggggcggaacgcctcggcattttattgtttatttttattgacttttgtaacgtaagtagttaatatcaagttatagagtaaccggttactttgaacgcagataagcattcccccgcttcaagtgcgcggagcactaagcggcgggtgagagggatgcttatgtcaatgggagttgaaagctcccgctgacagatcgcaaagcgactgcgttcatgagaaagtagcgaagcggattgcgaatgtccgctttactgaaaaaagtgacaaaaataacaaaaaaaataagaagagatagtagaaaggaaaaaatttatgaaacaggacgtattacatttaaaatccccagtcaactggataaatgacccgaatggttttatttattacaaaggaaagtatcatttattttaccagcattttccttatgctccaatatggggaacaatgcactggggtcatgcggtaagtgaagatttagtgcattgggaacataagaaaattgcattatttccgacaaaatcttatgacagaaatggtgttttttctggaagtgcaattgaaaaagatgagaaactttatttctattattcagcagtacgctatctggaacaggatgaagaaaatattcatctttctaaaaatgaccagattgagacaagtcaggcgatgctgatttcagaagatggagaaaagtttgataattggaacggaaaaaaacagattattccggtcattcgggatgaagaaattgcagatgccagagatactagagacccgaaggtctggaaagaggatgaaaagtattatatggtacttggaagcacctatcatggaaagcaggcaagagttttgatttttgaaagtgaagatggagaaaactggaattataaatctcagtgtcggaaagagacttatggtcatacgatggagtgtccggatttatttaaaattcgtgagcagtatgtttttgtcggttctccaatgggaattcaaaatgatggtttggaatatgcgaatcagtctgtctgtacattggcaaaatttgatgtcaaaaccgggaagttaagtttaccggatgagtatcagatggtggactatggcggtgatttttatgcgccacagagcaatctggataaagatggaagaagagtgatgattgcatggatgcgtatgccaaaaccggtagaatcaaaagatggaacacagtggatcggaatgatgtgccttccacgagtggttggaatcaaaaatggacaggttacatttgatgtgcatccgaatgtaaaagaaaactttgaagaaatagatttaactaaagtggtattaaaattaaaagaaaaacagccactttggataacaacgactttatcagaaggagaagaattagaaatcggtggatacgaaattcgtctggaggatggagcagttgtaggaaatcgtgaacgtgtatttgcagatatggaaggatatcatgtggaaaatcagaccccgaaagtagggaaatctgcaaaactggatatttttgtggaagaaaatttaattgaaatttttgtcaatgatggacagtatgtcttaagtcatgtggtttatggattaggagatacactgaatggaaagattcagaaggttcgagtattgaaataaattatgacaccgccagatattttcatgtatctggcggtatttgcttatgctgctccatataaaatgactccttctctatgaatattagaataaaatggataatttacaatccaattgttaaaatgagcttcacttttagcaattggttttatatcaatattataatccatattaaaatcatacatcatataggagagtttttgactgtatgctttaagttccaaatctgataaatctaataaaatcataatatcaatatctgagtcaggtctaaaatcacctctggcgtaaatgtgtgccgtatatctgctttatttcatttacatattgtttaattaaattttgcatatttcctggcatatacatttcccctttagatttaaattgatataatataggttacgtttttattatacccagattttctttttttttccagattttatttgtaaagaaattttcatttgcattacttaagaaataagatatactagaattattaaaagcaaaagggggtttttagatgattttggtaggtattatgctggttacggaccttatcatggttgcaattgtggcagcagtttatggtggaaaaacaaagtatcaaagcggaatgatacttggaatacatcttccaaaagaagtaatttctcaactagaagttgtagaactgactcagaaatataaaagaaacagcagatacttttatattttaaatttaatgcttggctgtgtggtctgccctcttggtttttggtatacctcaattttgatgattgtctggagtatctggttttttgagtttatttttggttctatgaaaatcctgtattcggcgcatagaaaattatatgagataaaaataaaaaatggctggggtcaaaatccggcaggtttagcagaggcttctgtgccagatgaagattattattggagaaaaggctggtatgagaatccggaagatccccatttctgggtgcaggatcgctattccagtactaattacagtcttaatatcggaagaaaaggtggaaaaattttcctggcagtgattacaattggaacgttgtcattatttatctggatgtgcgtgatgtttgtgaggatggattttactccggtgcgtctaaaaatagatgccgaacatgtaaaaattacttcaggatatacaggggcagaatttgataaagatgaaatagaagagataaaattgattgaaaaactaccggatgaaaaatttgtccgcacaaatggctcggcagatggaaatcagtggcttggaaaattccgtggaagcaagagcggagcgtgccggatgtatgtctggttaaaagaaacgccaattatcgaaattaagacagataaatatacgatttttattaacagtaaagaagatggtcagacggagaagtggtatgaaaagttaaattaaaaaagcggagagtcataaaatgtagtttacttatacacaagaaaagaaatttacaaaacagcaggtacatgaaaaaatattgactctacaatagatgtagggtttaatgttttttgtgaaaggagttgtcagttatggaaaacaatttaacttccggcaactctgtttccgatgggacttgcaacagcctttggttttttaggctctgtttttatctgcattggagcatttttgtggtttaagaaaacaaaacgactggtggcagtacaaaatggataacaagaaactctttcggattggtgaaatggcaaaactttttcacttaagcgtgcagactctgcgtcattgtcaactacccaccacctaaaggtagtgggcttgtaactgcccagtcgtaatgaatatttgaacaaaaaaaccactgcaacacagttttgaactgttcagcagtggcttttttgaatttgttgttatgcaatagatttaagcaatagatttaaaaaggacggttttatatttataaagtgcttcgtataaaatcagtccaatcacacctgcggaaatgacttcgccaactccgactgtcagcatcataaatggaatcggaagtggtacggcataagcatattttaatacgaatggtacgatgatggtatttgcaacaactggtggaagcggagcaagatatttgcttttatttctaagcatgcgtgtaaaaacggctccgattaaagttgcaatgcttccaaagataatatccggaagaatcgcaccgcctaaaatatttccgagaaggcatccgataaataaacctggaattgccgccggagtaaagaccggaaggatagtgagggcttctgcaaaacgaatctgtacttcgccaaatgcgagagaagcaccaaggacagtcagtacaacatagatagctgcaatcatggcagcctgtgctaagaaaagcacttttgagttttgatttttcataatatttttctcctgtagttttgttttacgtgtggaaggtcacgaacacacgattactaaaacccgaaagaccttggttaacaggggtttcagcggttgttagtatagcatgagaaaataaaaaaatcaaggaaagtaccaaaaaagtaccaaataggaaaagtggctggaaacttgcttaatttggttaaaaatttaaagatgtgcaatgcaaatataatgcattgacaaaaatattgcaaaagtataatctgatggtagaaaagggtgttaatatagcaacaacgaattttacaatgagaattgacgaggctgttaaagctcagcttcagcaattaatgaaagataagagatagaaagagcaggattaaaaatgaaagtgagggttttcatatgaaaaattattcagaggacgcaagcaaacagtatcatattcaggtaggagaaggcgaagttggacgttacgtgattctaccgggtgacccaaagcgctgtaaaaaaattgcacagtattttgaaaatccggttcttgtagctgacaacagagagtatgtaacttataccggaacattagatggagtaaaagtaagtgtaacttccactggtatcggtggaccgtcagcctctatcgcaatggaagaattataccgctgtggagcagatacctttgtccgaatcggaacttgtggaggaatgcagacagaagtaaagagcggtgatattgttattgcaactggtgcaatccgtatggaaggaacaagcaaagaatatgctccaatcgaatttccggcagtcgcagatttaactgttatcaacgcattggtagaaggagcaaaaaaagaaggctgtgaattccatacaggtgtggtacagtgtaaggacgcattttacggacagcatgagccggagacgaaaccggtcagctatgaactgatgaataaatgggaagcatggaaacgtttaggatgtctggcttctgagatggaatctgcagcactttttgtagttgcaagttacttaaaagttcgagtgggctcttgcttcttagttatagcaaatcaggaaagagaaaaattaggattggacaatccggtggtacatgataccgataaagcaattcaggtggcagtacaggcaatacgtgaattgattcgtgcagataaagagaatcagtaagattaactgttaaggcatcaaagacgcagaaaaatttcttgcacttggagcagaccgtcttggagtaagccggattgtaaaaacggtgaaaaaagaagaagcaacaggatattgatattaaagaaaaaaacaatagttgagctgtaaaacgaaaggcaggaaaaaatcatggacaaaaaacagattgaagaaatgattgatttggcagtcaggcagttagattactcctatgcgccatactcaaactttcatgtaggagcggcacttctggcaaaaaacggaacttattacacaggatgtaacatcgaaaatgccggttacaccgcaacaaactgtgcagagcgcactgccttttttaaagcagtcagtgaaggagtaaaggaatttcaggcaatctgtatcgtaggtggaaaagatggggtgatcactgaatatgcagcaccgtgtggtgtgtgcagacaggttatgatggagttttgcaaccctgaaacatttcagattattctggcagtcagcaaggacaaatatgatgtctttacgttaaaagaacttcttccgctgggatttggaccggccaatctggcataacaaatagtaaaaaattatatggtatattaacatggttttgtgtcggagcagacagaaaggaattgttatggaaacttataagagagtatttgtgattgttttggattcacttggaattggtgcaatgccggattctgaaaaatttggagataaaggtgtagataccttcggacatatcttagataagatgggaacattgaagattccaaatcttcagaaactgggaatgttaaacctgcataaaggcggaaacatggaaggtgtcgaaaaaccaatcggacgttatatgcggattggcgaagccagcaacggaaaagatacaatgaccggacactgggaaatgatgggaatttatactccgaaaccgtttaaaacctttacggaaacaggatttccaaaggaattaatcgatgaactcgaaaaaagatgccacaagcgtgtcatcggaaataagagtgcaagtggaacggaaatcatcgaggaacttggagaagaagaaatcaatacaggagcaatgattgtatatacttcggcagactctgtcttgcagatttgcggaaatgaagaaacttttgatttacagaatttatatcattgctgtgaaattgccagggagttgaccttaaaggatgagtggagagtcggaagagtcattgccagaccttatgtcggaaagaaaaaaggcgaatttaaacgaaccagtaatcgtcatgattatgctttaaagccaacaggaaaaaccgcattaaatgctttaaaagatgcaggatttgacgttatcggtgtcggaaaaatcaatgatatcttctgtggagaaggcattacaaaaagctatcattctgaaagttcggtacatggcatgcagcagacagtggaaatctgtaaagaagagtttcatggactttgttttgtaaatttagtagactttgacgcattgtgggggcataggagaaatccggaaggatacggacatgaaattgaaaagtttgacgaaggacttggaaatttattaaacgaaatgaaagaggatgacctgttgattctgaccgcagaccacggaaatgatccaacatacacgggaacagaccatacgagagagtatgtgccgtttgttgcttattctaagaaaatggaagagggcggagcaatcgaaaatcaggatacttttgcggtgatcggagcttctgttgcagaaaactttggagtgaaaatgccggaagacacgattggaacttctattttaaaccagttgaacgcagataagcattcccccgcttcaagtgcgcagagcactaagcggcgggtgaggggggatgcttctgtcagtgagagttgaaagctcccactgacagattgcgaagcgactgcgttcatgagcaagtagcaaagcggattgcgaatgtccgctttacgtaaaagagataccggcggaaaaaatataaaaaggaagagacaggctgattgatatcagtaggtctcttcctttttgcagaggtttgtatgtattaatttttatagagggaacagtaactataactgtttattttttgatgatttctttcattacttcgtaagtacctttggtacggatttcttcaagacaagtggtaactgcatgttcaaatccatcgattgtgcttagatcttcaccccagaatgaggtatttgtgcagactgcatgaaccaggtcttttgcactgtcatctttgtgtgaatagaaaaattctaagacatcagtatcgtcttttacggtgtaagtaccgtttttgcgggatgcattcagtccgtcagcagttaattcctgaccattgtagaacgcaatatagaaagcgaaagatgcagtgatgcatgctggaaggcttcctcttcttgcaacatattcttttaaagaaggcataacacgtgctctccattttgaagtagagtttaatgaaattgcaagcagcgcatggtcgataaatggatttttgaaacgttcggtaacggcagatgcaaagtcttctaattcttcttttgaaaggtcaagagtcggaatgatttcgtcatagatggtctgattcataaagctgcaaatcacttcatcttccatacagtttcttacgatatcttgtcctgcgaggtatgcaccaagcacgaaagaagtatgagcaccgtttaagatgcggactttgcgctgtttgtaaggtttgtgattgtctgtaacaagaaccggaagtcctgctgatttagcaggaaattctttttctaaagtttttggtccttcgattacccagaagccgaaaatttcaccggtcgttaaaatggcatcttcataaccgttttcagcagttaaagtttctgcttcggcagatggatatccagttacgatacggtctactaaagtagaacagaaaaggttttcagcctcaatccagttgatgaactcttctccgagttcccactgttttgcatagtttaagacgcattttttgagtgcttttccgttatcttcaattaattcgcaggaaagaataatcagaccttttctggattcttttccgaatttttggaaacgacggtataaaacctgagtcagttttccagggtagctggaagccggagcgtccgtaaactgacaggaagcatcataaacgatacctgcttctgttgtattagaaaccacgaaacgtaacgcttcattgtccgcacaggcaagcagtgcttcaaaatcgtcataagggttgatgcatcggctgacacaggaaaggatacgcttgttgtttactttctgtccatcttgaaatcctcttaaatataaagtataaagcccttcctgttcattgatagcggcagctactttagaatgggatgcagttggtttgcagatgacaacttttgagttaaaacccgctttttcgttcatcacatcaataaatgcatctgtaaaggcacgtaaaaagttaccctctccaaactgaagaacacgttcaggggcatcttctaagagatacccgtcataattcatttcatgaagggtttcataggataattttttcatctttttcttctcttttcttctgattattttatttaagttcggaaactataaattaaagggtgacgccctgcttgaagattgccatgtcatggaatccggcttcttcagatttggatttctttccggatgcgatttcaattacaaaatcaaagagtttagaagaaagagagtctaaggtttccccttctactaaagtcccacagttgaaatcaatccagttattttttttatttgcaagtgtagagttagttgcaatctttacagttggaaccggacttgcaaatggagtgccacgtcctgtggtaaataaaacgatgtgtgcaccggaggctgcaagagcagtggaggcgactaaatcatttccgggagcacttaaaagatttaagccgtgtgtacagactctgtctccataagaaagaacaccttttataggagcacttccggatttctgggtacatccaagagatttatcttccagagtggaaattcccccttttttatttcccggagatgggttttcgtaaatggtctgattgtggcttttaaaataatttttaaaatcgttgattaagttcacggtctcatcaaaaagtttttcattttcacaacgattcataagcagggtttctgctccaaacatttccggaacttctgttaagacagttgttccgcctttggaaattaacaagtcggaaaatgaaccgacagttggattggcagtgattccggaaagtccgtcacttccgccgcatttcattccgataaccagttcgctacagctgatgggttctcgtttgaaacttcctacatagtctgcaaggtctgcaattacatccagtgcatcggaaatttcatcttcacattcctgagcaaccagaaaacgaacgcgtttttcgtcgtattcgccgatgtatttttttaattcttcgatgttactgttttcgcagcccagtccaagtaccagtacaccaccagcatttggatgattgattaaatcagcaagaatctgtcttgtatgttcctggtcgtctcccatttgagaacatccgtaagggtgtgggaaagcaacgatttcttcaacggttccttttttataaacctgagcctgtcgttcgacagcagttgcgacattgttgacacagccaacggtcgggacaatccagatttcattacgaacaccgacttttccgttgcttcttctataaccatcaaagaaacgttcttcggtttttttgacttccggatgaaccggctcataagtgtaagtaagcaggtcgccaagaccggtgcggatattgtgtgtgtgaatccaggaaccggttgtgatgtcttcttttgcaagaccaatctgtgaaccatatttaataacaggttcgtctgtcttgatatctgttaaggcaaatttgtgtccttgtgggatatcttctgataaagtcactgtctgactgccgagttcgacaaccagtcctttggataatggagcaagagcaactgctacattatcattggaatgaatctttaaatatttttgcattggaaaattcctccattaaaaattgtaagagcttacataaaaaatacaacgaaacgctttaatagtcaatataaaagatgagaaacattaaaaaaagcataattttaggggaaatagacaaaaatagatgggaaagattgtgaaaaaatttgcggaaaagtgtttgctatttcggtgaaagcgttttataattcaaaatgaaatgtaaacgcttacctatgcgtgcaaaaaaaagaaaaaagaaaggaaaatgaaacttatgaagagattaagaagactgtttgtctgcctggtctgtctgtgcgtggttatgagtgctcaaggatgcggttctattgcaggtgtttcaagtggcaagagaattattcgtatttctcatgcgcagtctgaaacacatccggaacatcttggactgttaaagttcaaagaatatgttgaggaaaatctgggagataaatatgaagtccagatttatccaaatgaaattttaggttctgcacagaaagcaatcgaactgacacagaccggagcgattgactttgtagtggcaggaacagcaaacctcgaaacatttgctgatgtgtatgagattttcagtatgccatacttatttacatcagaagaagcttaccatgaaaccatgaacgatactgattacatggaaaagatttatgaatctacggatgatgcaggttttagagtattgacatggtacaatgcaggaacaagaagcttctatgcaaagaaaccaatctatacaccggatgacttaaagggacttaagattcgtgtacagcagagtccggcaagtgttaagatggcaaatgcatttggagcagcagcatcaccgatgagctttggtgaggtatacacagcgattcagcagggtgtcattgacggagcggaaaataatgagctggcgctgacaaacaacaaacacggtgaagtcgcaaaatattattcttacaacaaacatcagatggtaccggatttattaatcggaaatcttaaattcttaaatagtttaagtgatgaggaattccaggtttttaaagaagcagcacgtctttctacagaagtagaaatggaagaatgggatactcaggttcaggaagcaaaagacattgctcagaatcagatgggtgttgaatttatcgacgttgatgtacagcagtttaaagataaagttgcaggtgtacaggaagaaatgttagaaagcaatgaaaacatccgtgatctgtatgaccatattcaggaaattaacaaaaagtacgagtaggaggggtacgatggaagcagtaaagaaaatcaaaaatgggatgaatgcagtcttaagtttcttatgtatcattctctttgcttttatggtatgtgtaggaacctaccagattgtcacacgttttgtttttaattccccgagtacggtatcagaagagcttctgacttatagctttgcatggatggcattgctttcttctgcactggtatttggaaaacgtgaccacatgagaatgggattctgggcagataagctgaccggaacaaagaaaaaagttttagaattggtaattgaattaattgttcttatttttgcagcgagcgttatggtgtacggtggttctaccattatgaaacttacaatgacacagaaaacagcttctcttggaattccaatgggaatcatttacacagttgttccgcttagtggaattgtaattgtaatttatgcaattttaaatatgattgaactgtgcaagggaaatttagaccagccggtggctgaagaaaaataggaggagtctgatttatgagtatagcaattgtatcaggaatcatcattttggttctgctggtcattatgttagtcgcaggtgtaccgattgctgtagcacttggtgtatcatctgtatgtgcaattcttccggttatggatatcgacgttgcggtattgaccggtgcacagcgaattttttcaggaatttcagtatttagtttattagcaattccattttttattcttgccggaaacatcatgaataaaggtggaattgccatccgtctgattaaccttgcaaaattaatcactggacgtactccgggtgcactggctcagacaaatgttatcgcaaacatgctctttggagcaatttccggttctggtacagcagctgcttctgctatgggttctattatcggaccaatcgaaaaagaagagggatatgacccgaacttttccgcagcggtaaacattgcgacagcaccgacaggacttctgattccgccaagtaatgttatgattacttattctttagtaagtggtggaacatccgtagcagccctgtttatggcaggatacattcccggaattttatggggtcttgcatgtatgcttgtaatttacatcattgcaaagaaaaaaggatatcgtgcaaaatcaacatttacagcaaaagaagccggaaaagttatcttacaggctctgccatgtctgcttttgatagttattgtaatcggtggaattattggtggtatctttacagcaacagaaggctctgttgtagcagttgtatacagcctttgcctgtctctgtttgtttataaatccattaccttaaaagacctcccgaaattattcaaagagagtgctgaaatgacaggtatcattatctttttaattggtgtatccagtatcatgtcatgggttatggcatttacaaacattccggaagcagtatcaagcggacttcttgcaattacaaataataaatacattattttcctgctgattaatattatcctgcttgtagttggaacattcatggatatgacaccggcatgtctgattttcacgccaatcttccttccagtctgcagtgcacttggaatgagtaccattcactttggcattatgttaatctttaacttatgtatcggaacaattacaccgccggtaggaacgacattgtttgtcggtgtaaaagtcggaaatgtaaaaattgagacagtatttaagcagttgcttatttactttgcagcgatacttgctgtattattattagtaacctatattccacagcttagtttatggctgccaagtctgatggggtatgtataaagggaaagcgctatcattcacgcaggcgcacgcagtacagtgaaagttaagtgctgttatattgacgcagaataattgcttcagatacaaggcggaggaatgaggcgtagcagtagctacggcgattgacgacaacgcagtagatgaaaaattagacaagtcaggatgacagttgcttaacaatttcactgtacaaactacttgtcgctggcagcggtacataagaggcatagcctctaagtaccggccgctccaaagtgtctgcttgtgaaaagatagctaatcaaaagttccaatggatgaagttacttagtaaagttcaagttgaatgaatgtgaagcttggttcatgttttttggttaaccatattttatattgactataatgaagtgtagtaaaaaatagattgttgatttatttggactaaattgcatgtcaggagtatttgattgataaaaaagtaatgaatggaactttagaagatatctattatgtaccgcaggagagcacctgtggtgaagcaagaaattttatttaaggaggcttttgtaatgaaagcatttatggatcaaaactttttacttgaaactccgaccgcacagaagttatttcatgaatatgcaagtcaggtgccggttttagattatcactgtcatatcaatccgcaggaaatcgctgaggatagaaaatttgaaaacatcacacaggtatggcttggtggtgaccattataaatggcgtcagatgcgttctaacggagtagatgaatattacatcactggcggtgcatctgaccgtgaaaaatttcagaaatgggcagaaactctggaaaaggcaatcggaaatccgctgtatcactggagtcatttagagcttagaaaatatttcggttatgaaggctatttaaatggagaaactgcagaagaagtatggaatttatgtaatgcaaaactgcaggaggacagcatgtctgttcgcaatattattaaacagtctaatgttactttgatttgcacgacagatgacccggtagatgatttaaaatggcatcagatgattgcaaaagatgacagttttgatgtacaggtacttccggcatggagaccggacaaggcaatgaatctggaaaaaccggaatatctggattatgtaaaaactctttctgaagtaagtgaagtaaaaatcgacagcttcaaggctttaaaagaagcacttgtaaaacgtctggattatttccaggcaaatggctgtaaagtatcagaccatggtatcgagtatgttatgtatgctccggcagatgatgcagaagtcgaaagaatttttgccaagagacttgctggtgaagcggtaacaaaagaagaagaattaaaattcaagacggcatatttacagttcatggcagaagaatattataacagagactgggtaatgcagcttcattatggatgcaaacgtgataacaatacaccacgttataagcagttaggtccggatacaggatatgattgcatcaacaactatgcaccaagttctgaaacggcagatttcttaaattctttaaatgtagcagataagatgccgaaagtgattttatattctttaaatccgaatgataatgcagcaatcggaacaattttaggatgttttcaggacagcagtgcaattggtaaaattcagcagggtagtgcatggtggtttaatgaccataaaacaggaatgattgaacagatgacttctcttgcaaatttaggtctgttaagcaacttcatcggtatgctgactgactcaagaagcttcctgtcctatacaagacatgaatatttccgaagaattatgtgtaatttaatcggcggatgggtagaaaacggagaatatccagctgactacaaagcattagaaaaaattgtaaagggaatttcttataataatgcggttcgctattttggatttgacttataagaaaaacaggcttattattaatagaaatactttttgtgaacgcagataagcattctcccgttttaaatgtacggggcacgaaacagtgggtaagggggatgtttatgtcagtgagaacctttcgctctcactgacaggtcgcaaagcgactgcgttcataagcaagttgcgaaggggattgcaaatgtccgctttacagcaaagaggcatggattttaaaactgaaaatccatgcctctttaaagaatcagaatgatagaaagatgaggaaacaaagtcattaacatttacgatatagccagaatttccggtgtgtcaatcgcaacagtttcaagggtggtaaacggaagccagaaagtcagtgaaaagaccagacagaaagtaatggatgtgataaaagcagagggctatacgccaaatatatttgcgagaggacttggacttgattcaatgaaaacgattggaattatgtgtccaaacattgcggataactacatggcaagagcaatttctcacctggaacaaaattttcatgaatatggatatgactgtattcttggatgcagtggacacacaagagaagcaaaagaaaattatgtaaaattgttattatctaagagaatcgatgcgcttgttatggttggttctacttatggtggaaacggagtagaagaaaaggagacggcttatattaaaaatgcgtcaaaacaggcaccggtctttttgattaacagctggattgagggagaaaatatttattgttcgaatgcagatgatttctctgctgcttatgaagtgaccagcgcattgattcgccgtggaaagaaacggattttatttttgtatgattcggagactttcagtgcaaagcagaagatggagggctacgaaagggcgctttccgatgccggctatccggtacttggagatttgaagttccgtaccaaaaacgaaattcatcatgcaagagatttgatgcttgcgtataagaatctggagtttgacagtgtatttgcagtagaagacgggcttgctgttgctgctttaaagtatgcaaaggtaaaaggaatttcggtgccggaagaactttctgtggttggatataataactcaccgctttctgtaagctgtgagccagaactgacttctgtagacagccggattgaacagcagtgttacatagcggtggaaaacattgtaaaagtgttagagggaaatacagaagtttcacaccgtaccattgtgccgtgtgaaatcgttaagcgttgtacgacagatttctgattcatttttgtaaaaaaagattaaaaaagaacgcttgacaaattaaaacacaatgctataattgactcatcaataagaaaatacgttgacgagatgagtaagatgtggaaacgtttcagagagaggcagccggaacttccggtgctggaactgccttagcgggaaccatccgaaaactacctctgagtgaccccaatccggtccggtgattccgttatcatcaaaatgaagtggtttgaaaatcagtgtaacagctgatttgtttagatgaaaagcaaaaagggtggaaccgcgggtaatgtctttgctcgtcccttgcatgaaaatgcagggatggacaaggactttttttattccataaaaatctctgcgaaatagataatgatattgataaatgtaaatgtacttttggaaagtattctgcaagagcaggggaaagaaagattctaagagtgcataaataaaaaacaggaggaaaaaagttatggttatcacattaaaagatggttctaaaaaagagtatgaagaagcaaaatctgtaatcgacatcgcttatgatatcagcgaaggtcttgcacgtgcagcttgtgccggagaagtggacggagaggttgtagacctgcgtactgttgtagataaagactgtgaagtaaatattttaacagcaaaagatgagaaaggtcttgcagcactgcgtcatacggcatcccatgtattagcagaagctgtacagaaattatatccggatgcaaaagttgcaatcggaccttctattgatacaggtttttattatgattttgagtgtcagccgttctcaagagaagcgctcgatgaaattgaaaaagaaatgaaaaaaatcatcaaaaaaggtgcaaagattgagcgtttcacaaagacaagagaagaagcaatcgcatttttcaaagaaaaaaatgagccttataaagtagaattaattgaggatcttccggaaggagaagaaatcagcttctattctcagggagactgggttgatctatgtgcaggtcctcatctgatgagcacaaagggtgtaaaagcatttaaattgctttcttcttcaggtgcttactggagaggaagcgagaagaatcagatgctgactcgtgtatacggaactgcttacggaagcaaggatgaattaaaagagcatctggaacagcttgaagaagcaaagaagagagaccacaacaagctgggtcgtgaaatgaaattgtttacaacagttgatgtaatcggacagggtcttccactgattatgccaaatggtgtaattatcatgcaggaacttcagcgctggattgaagatgaagagacaaaacgtggttatgtccgcacaaaaactccgctgatggcaaagagtgatctgtataaaatttccggtcactgggatcactataaagatggaatgtttgtattaggtgatgaagaaacagataaagaagtatttgcacttcgtccgatgacctgtccgttccagtactatgtatacaaagcagaacagcacagttatcgtgatcttccactccgttatggtgaaacttctactctgttccgtaacgaagattccggtgaaatgcatggtctgacacgtgttcgtcagtttacaatttctgaagggcatctgattgtaagaccagaccagatggtaaaagaatttaaagattgtattgcactggctcagtactgtttacaggtacttggtgtagaagaagatgtaacttatcatctgtcaaaatgggatccggaagacaaagaaaaatacatcggcgagccggaagtttggaatgaaacagaagaacacatccgtaatatgttacaggaattaaatattccattcgtagaggatgtaggagaagctgcattctatggtccaaaagtcgatatcaatgcaaagaacgtttacggaaaagaagatactatgattacgattcagtgggatgcactgcttgctgaacagtttgatatgtactatattgatgaaaatggtgagaagaaacgtccttgcattatccatcgtacatctgtgggatgttacgaaagaactttggcatggttaattgaaaaatatgccggcatgttcccgacttggttatgtccggaacaggtgcgtgtgattccgatttctgaaaaattccatgactatgctgcaaaagtagaagcagagttaaaggaaaatggtatccgttgttccgtagaccagcgttctgaaaagatgggatataagattcgtgaagctcgtcttgcaagagtaccatatatgctggtagttggagcaaaagaagaggaagaaaacaaggtatctgtaagaagtcgttaccttggagatgaaggtgcaaaagatttagcagatttcatcggtgcaattaaagaagaaattaaaaataaaacaattcgtaaaattgaagtagagaactaataatctggggatatcggtgagtggcaaaatttacttttgacactcatatcgtaaaatatttcagataagagaaaggcatttatttgttgaaaggcagataaatgtctttttcattttattaaaatttaaaatcttctattgacaaatacctaatgggggtatatagtgaagatacccacagggggtatttgaagttgaaaaatcctatagttgtacaatgcgaactaccacacgccataaaggcatgtggttttatggcgatagaaacttataaaggagcgtgtatgtagatgtctgaagaaaagagaggctgttgttgtggcaaaaagacaacaatgcgttcggaagaggaacgaaaaaaattaatcaaccgtctaagcagaattgagggacagattcgtggaatcaagggaatgttggaaaatgatgcgtattgtaatgatattctggtacaatcagcagcagcgagcgcagcaatcaatgcatttaacaaggaactgcttgcaagccacattcattcctgtgtggtcagagacattcgggaaggaaaagatgaagtagtggatgaattagtagctactttgcaaaaactaatgaagtaaaaattacaaactgcaaattagaaatgaaaaacagagagaggagttgaaaaaagttatggaacagtatacggtaaccggaatgagctgtgcagcttgcagtgccagagtcgaaaaagcggtttccaaagtaccaggtgttacttcctgttcagtcagtttattgacaaattcgatgggagtagagggaagtgcagacccgacaagtattatttcagcagtggaagcggctgggtatggtgcatctgtaaaaggagcagataaaaaggcgaacacgctggcagcagatgaggcagcgctggaagataaagagacgccggttttaaagagacgtctgattgcatcggttggatttttgctggtattgatgtatttttccatgggacacatgatgtggggctggcctttaccggcatggtttcaggacaaccacattgcaatgggaattgtgcagatgattctggcggcaattgttatggtgattaaccagaaattttttattagcggatttaagagtttatggcacagagctccaaatatggatacgcttgtggcaatgggttcgatggcatcgtttgtatggagtgtctatgtactgcttgcaatgacaagagcgcaggtagatggaaatatggatgccgttatgaattatatgatggatttttattttgaatccgcagcgatgattctgaccctgattacagtcggaaaaatgttagaagcaaaatcaaagggtcggacaacggatgcattaaagagtctgatgaaacttgcaccgaaaacagccgtgcttgtaagagatggaaaagaagtaatggtttctatcgatcaggtacaaaaaggtgatattttcgttgttcgtccgggagaaaatattccggttgatggaagaattttagagggtcacagtgcagtcaatgaatccgcactgaccggagaaagtattccggtcgataaagaaacaggagatttggtttctgcggcaaccatcaatcagtcaggatttattaaatgtgaggcaaccagagttggagaagacacaactttgtctcagattatcaagatggtgagtgatgcggcagcgacaaaagcaccgattgcaaagattgcagataaggtttccggtgtgtttgttccggcagttattacgattgcagtcattacaaccattgtctggctgattgcaggacagagtgttggatatgcgttggcacgaggcatttctgtactggttatcagctgtccatgtgcacttgggcttgcaactccggttgcaatcatggtaggaaatggaataggtgcaaaaaacggtattttatttaagacagcggtttctctcgaggaaacaggtcgtgtgcagattgtggcactggataaaaccggaacaattacaagtggagagccaaaggtaacagatatttatccggcagatggagaaaatgaagaaagtctgttaagagaagcggcaattctggaacaaaaaagtgagcatccgcttgcaaaagcgattttggaaaaggtgaaagaaaagaaatggatgcttgaagaggcagaggaatttgaggcgctcccgggaaatggtttaaaggcatcttataataagaaagaactgcttggtggaagcatgaaatttatgcaggagcagattggaatttccgaggaaatgcagaaacaggcacagcattttgcaaaagaaggaaaaacaccgctgttctttgcaaaagagcagaaactgcttggtatgattgccgtggcagataccataaaagaggacagcccaagagcagtcaaagaattacagaatatgggaatacgtgtggtgatgctgaccggagataacgagcggacagcaagagcaatcggggcacaggctggtgtggatgaagttattgcaggtgtgcttccggatggaaaagaaagtgtgatccgtaagttaaaacaaaaaggaaaagtggcaatggtcggcgatggaatcaatgatgctccggcactgacaagagcagatatcggaattgcgattggagcaggaacggatattgcaattgatgcagccgatgtggtactgatgaagagtcggttaagtgatgttccggcagcagtgagactcagccgtgcaactttgaaaaatatccatgagaatctgttttgggcatttttctacaatgtaattggaataccgcttgcagcaggtgtctggattccgatttttggctggaccttaaatccgatgtttggagcatttgcaatgagtctttccagtttctgtgtcgtatcaaatgcattgagattgaatttatttaaggtaaaagacgcgaaaaaagataagaaattaaaaagtgaagtcagcgtatccgaactttctctgacacagacagatggtgaaacaaagactttgaaaatcaagggtatgatgtgtggtcactgcgaagcaagagtcaaacaggcattagaaagccttgagggagtggaagaggcaaaagtaagccatgaagccggaactgcggtagttattttaagtgcaccggtggatgagaaactcatgaaacaaaacgtggagaaagagggctataaggtcctttcgatcaaataaaaaataagagaggtataaagctatggtaaaaacaacacttggaatcgatggaatgatgtgtggaatgtgcgaaagccacatgaatgatgcaattcgcaataactttgatgtaaaaaaggtaacatcttctcacagtaaaaaacagaccgaagtgatttcagaagaagcattagatgaaggaaagttaaaagaagtagtagaaaagactggctatcagttgacttctgtagaaacagaaccgtatgaaaagaagggattttctctgtttcacagataagaaaatagtaggaactgttttttagaaaaacgatagaaaggacgttgtggagagcagcgtccttttttcttttggcttaagtaagaagaacattgattttcctttaacacaagattataataaaaaataacgaaattttgagacgacaaaaaggagaaaacgagtatgatagcagataaaatgaaagcacttgtaaaaaacagctcagcaattcgtgccatgtttgaagaaggaaaaataatggcagcaaaatacggggcagaaaacgtatatgatttcagccttggaaatccaaatgtgccggcaccggttcaggtaaaagaggcaattatcgaggaagcagagagagaagacccgattgtactgcacggatatatgagcaatgcaggatatgaggatgtgcgtcaggcagtagcggaatccatcaataaaaaatttgatactgcgttttctgcaaaaaatattattatgacagttggagcagcaggtggtttaaatgtaatcttaaagacattattaaatccaggagatgaggtcattgcaattgctccatattttggagaatacaacagctatgtttcaaactttgatggaaaactggttgtggtaagcccgaacaccgagactttccagccaaatcttacagaactcgaagaaaaactgactgcaagaacaaaggctgtcattgtaaattcaccgaataacccgactggagttatctattctgaagaaaccattcaggcaatggcagaaattcttcgtaagaaacaaaaagaatttggtacagatatctatctgatttccgatgagccgtatcgagagctggcttatgatggagcagaagtgccgtatttgacaaaatattatgaaaatgctatcattggttattcctttagtaagtcgttgtctcttccaggcgagagaattggttatcttgttattccggatgaggcagcggattcagaggatgttatttctgccgcaggtactgcgacacgtattttaggctatgtcaatgccccgtctctgatgcagaaagcagttgcgaaatgtttggatgcacaggcagatgtgccatattatgacagaaacagggaagatttatataatggtttaaaagagatgggatttgaatgtattaaaccgcagggagcattttatttatttatgaaatctccggttgcagatgaaaaagtattctgcgaagcggcaaagaaacagcacattttgattgttccgggttcttcttttgcctgccctggatacgtacgtattgcttactgcgtagcacatgaaacgattattaattccatgcctggattcaaggcacttgccgaagaatttttaggctagtgtacggtatcattgataagtacactaaaaagaatgcgtttgtaactcctgtaaaaaagagagcacaagtgcattttggaaagttacaggaggaaagaatggagtcaattgtacattggtttgccgcaaatatgccgtcttttttatcaccggaggttgccgtttttcttgtctcgatggtgccaattctggaacttcgaggaggactgctcttagcaacacttttaaagattccgatgacacaggcgattgtaatctgtataattggaaatttaattccgataccgtttattctgctttttatcaaacagatttttaaatggttaaagaaaacaaaactctttcgcccacttgttgaaaagatggaaagaagagcgatgggaaaaagtgaccagataaaacggtatgaattctgggggctggttttatttgtaggaattccgcttccgggaacaggagcatggacaggctctttggttgcttctttattagaagttgatttgaagaaatctgttccggctatcttactcggactttgcatggctacggtaattatgtgtatcgtgggttatggagctcttggttcgattttatcttaaagtgaaaatgcgttgtagaagtcagaaagatttctacaacgcattttttaattgaaaaagaaaaactaaatatatatagattggaaagatacaaagtatgaaattactttgtataaaatcctataagatatgcaatcctataatagaatagtagaaagtttgccttaaatcagtcttagatttttctcatccaagatacttttacaaattttatattaagcgtaatttatacttttgtcaatctttttggaagtttttgggggatttaaaagcctacaaactgcttttttgtgcattttgaactatattagtggacttttttggtttaattgccgtcagaaaagttgtcaaacgcccaaacaaaaaagtctttataaagcctgtcataaggaacttaaaatatttacgaataaaaaaaggaatacctggtggcatattgttttttgaataattaagaatcataaaccgtcaaaaaactcgtcagatttttcgtaaaacctaaggaaataaggcataaacagagggtgtatcttggatgagaaaaatctaagatgcaccttaaaaattgcatgaagatagatgtcgaagagtgtaaatctctggatagaatgtctggagtgatgcaattagtaggtaataatgttggtgatagctgtgtttataagtatgaaaatacttagaacggaatccggttagaatccggagcagatcctttccctgctgtaaggacaacgaaagatgtaaaaggtcactgaataaatttcatttggtaagacacattgagtaggttaagaggtcctaagccagaagacgaagcacaaaaaacatttccaacaggaagtaagtaaattcggaggccaggaacgaatcgaatgaaaaacagaacaaaaacagaccctatcttttggataaggtgtgatgcagggttgaaagacctgcagttttttagtaagaattggttcgtagaatggctttcattgtacgagctttttttatggaaaaaatgaaagaaatggaaggaggagagaaaattttaagacgaaacacaaaaattcaggtggataaaacgaaagggggaagtgccatcaaagaaaaataagtttattggttttatgaagaaaaagaatcgtttttaatcaaatagatggagagcatgaagaatgaaagaaaagaaacaaatgagaagattgcttggctgtctgcttcttatggtgtgtttgcttggctgtttcaaagtaagcgtttatgcagcggaaaatgaaagagtcatcaatgttacaggaattaagactgtaaaaatctatacagcagataaaaagcaggaaattgaagtaaaggaaaacagctttacggcagtccctggagagtactgttatgagtatgtgggtggtggttcagcaaatggagcaggtggatattttacagtaacagaagatacaacggagttaaatctcagcagtgttacgttttcgaatgtatcgcctacttattttgataaggaagatggcaaatggaaatatcttccagaattgggaaccttaaccctgtatgatgaaaaacaggagaaggaatactggcatggtacagatgatgtatataattacattgtgccaaattgcggtggagatagttattataattttacatttacaccgtttgatgaaaattatcttccagtcgaaggtcatttttatgtttatggagagacaagctttggagcattaaatctttcagatagtgggaagattccgtatctgaaaaaaagttatattacagtcaaggcaccagtggatatggaagtgtatacgacttgggaattgaaattctatacagccagaaactggaaatcctatgaagcatataagactgaagatggttataattattacaaaattccagaaggcttcacgtatatgatgcgtcaggaaggaaaagtgactcgttatactaaaaatctaaatggggaatggaatgacgaccataccgaggtcacagttgcaccgcttgaggataatccaacacaggtacatagagaacaggaaaaagatggaatttatgccagcatgttaacgaacctgccggaaaacagtgagattgatttagaggtaggggaatactttgacctggtaccactgcgcgcatggcaagcattggaggatggtgtgagtaattaccataatgacccagactggcattatgtagttttgggaggaaaaacggtatctgttgaggtaacggaagatgataaaatagggcagtttggtcgaattcatgcaaatggtaaaggaacagccttagtagcattttattatgatgctgtggagacatcttcttttacgagtgatacaggaagttatctttatagtgcactgttgcctgaattggcaggaattgctgttgtacgtgtgggagaagaaactcctcagactcagattagttctaatattgatatgatagaggggcgtacagtttattatctgaagagccaaaccggagtagatggtaatacgtatgatttaaataattcggctgaatatacttttacgcctacggctaaaacaggtgataaagaggaaaaaattacttctgtaaaagtacacaaaccgattacagtgactgatggtataataggctgtggcggaagtacgaaatggaatcctaaaaactggttaaaggatggaaagtggacaacctatcaggcaaatgaaacagaggatggaaaacaaagttatacaattcaattagcagaaggacgtaatattgtagagataaaagcaggtgatgcaactacctatcatgtcattctggcccgtggtgtagatgtgacgattgataatgtatatcgaccaagacaaagcttactggatggagatactgtaaaggtaacgatagaaaatatgattcctccattatttaaaatgtcagcaatctataaccctgcaggtgtagattttgcttgtaaagcgaatggagtggattatacagggcattttggacagtacatggtaggaagtagttttaatataaaactagaggaagaggatgtaggcacttacaagattacggatggagcgttaacaactcatgcgtggggagcaacagatggtacacaccgcaaattgacaagaaatgcgatgtcaggttattggaatggtgggaataatccagatattgattatggaaaactggcatatattccagagatatcttttgaggttaaatctaacgatgaatatgaagaaagtgagaggcgttcagcaggattattaaaagccttgggagtatctttaaataaagttggaaatccaatgagtacaagcaatgctatgtttaagacaagcaattcagatgtgaaacagaataagaattgtccaacgtcattatcatcgttcttaacgttacctgttcaagttggagcggaattgctccaaaatgatgaagaagcaaagttaatgataagatattggcgaggagacgacaggaataatgcacttgtacaagagatagatttttcaaagattatatatagtagtactactggctcgccgctcatagttggaaatccattaaaatatacggggcaggagttagcagatggtgtatcaaaagatatacaggtagaagctattgtagttcctggagaaggaagtcctatgacgtatgctacatacatatatgattctagtagtaatacgaaagatgttacaggattttttattccaaaagatataacaatctcttctgctggaggaagcggagaacttggtcgttgggatggaattttggaagcagatgatattacatataaggattcagaaggaaatgaggtaacacaggaccttggatatggatttatcggaacagaagaacactttactacatctgtgccaaatggaacagataaaattctggtaaatgtagagggagaagttgcagttaatgcgaagtatctggaaagttatagtgtttcttttgatggaaaaacctatgaaaatggggaagcgattcctctggaagttggtgtgaacaaactgactgtgacatgcaacggaacgtatggaaaatctcgtacctacaccatcgacgtcactcgtcgtaccgctgcaaaacagacaacctttgaagttccagaaggagcctctgtacttgtaatgcagggtagtaaagtgatgaaagccaacgaagatggaacatacacccttgaaaatggaacatatacttactatgtatctaagagtggattcctgaccaagacagacagcttcaaagtaactgatgaggaaaccaatccggttatccgtgtggaaagtttagaagcagttccggctcagtctggaaccgtatcggtacagcttgccggtcagagtacggtattctgcccgacaacagatgtaactgtttcacaggaagcaaaagacctggcagcaaatcgttatgtcttatataaccatggtggttacaccgtacttcatgcattgttggatgcagcaaatgcaagtggaaccagttttgagtgttataaaggaaaactggtactggtagacgattcaattacagaaaacaatggaaagaaatccggatggatttgcaaggtaaatggtgtggtatgcgaggacccagccaatactttagcatccgacggagataagattgagctcttctataattctggatgggatggcatgaaggatgcacatctgacaccggaagtaaaagcagtgaacagaggagaaaccgtgactctgaccttagcaggagcaggtgtttccgaaaatgatgcaaacgcagaagccattgcggatgcagagatttatgaaggaagtacactggttggaacaaccaacgaaaatggacagcttgagttagaaaccaataccctttctttaggaacccatcgttttacggctgtaaagaaagatgaatccggtcataacattttaactgcagtcatgagttcgattaccgtaaacaaagtaagtgacccatctgcagacccgaacaagaccgttgttacattccgtctgattggtgataccaaacacggagaagagggaagtgacaacgaggcagttcatgcgtataccacatggattgcaactggtacttatacatttgaccaggcagaagtaaccgttggtgacgtatttaagactgcattggatgaggcaggactttcttatgagggaattgaaaagaattatatcagttccattactgcaccggaaatctatggttcttatgaattaaaggaaatggataacggtaaaaattccggctggatgtatacggtaaatggagttcatccagataaaggtctgaatgaatggtatgtgacaactggtgatgaaatcgtatggcattacattgatgactataaagtggaacaggctgacatgaaggatgattctggaaactatgcaacaggcggaaatgcttctacctggaataaatggctcgaagcagtcgatgaaactcctggtgcaaaggaaaatgcaatcaaagtcatcaatcagattaaacagattgacgaaacgattgaactgacagatgagtgtgaagcaaagattaccacagcacgtaaggcttatgatgccctgacccgtgaggaaaagggttatgtaaataattacgatgtactcttaaaagcagaggaacaactgtctgcccttaagaaagaaaaggcagataaagaagcagcggaagcagtgattgcccagattgatgcgcttccaacagccgaaaatgtgactctggaacatcaggaagcagttgatgctgcaagagatgcgtacagcaagctgactgatgaccagaagaaactgatttccaaggaaacaaccgacaaactggaaagtgcagagaagaagattgcacagttactcgaagagcaggcagcggatttggtattagaagagattaatgcgcttccatccaaagacaatctgacccttgatgatgaagtggctcttgcaggagcagaggcacactacaatgcattaagtgattcccagaaagagtatctgacaggaaaagcagcggaaagtgttgcaaaacttggtgaattaagaacgcagttagaaaaactgaaaaaggatgcggcagacaaagcggcagccgatgcagtgacagaaaaactcaatgcccttccatccgaagaggatgtgatgttccaggatgaagcagtcctgaaacaggcaagagaagcttatgaacagttagatgatacacagaaagctctggtttccagtgaagcgtatgacaaactggaaaaggcagaacagaaactggaggcattaaaagccgaagtcgaagcggtaacaaaacagattcaggaacttccggcggttgaggatttaacactggaagatgcagaaaaagtatcttcggcaagaagtgcttatgatgcgttaaatgcagaccagaaacgtcagttaacagaaagtggagtactggatacgctgttaaccgcggaaaaccagattagcttacttgaaagagaaaaagaagaagcagaaaaagtggcacagcagattaacagtctcccagaagtgaaagatttgcagctggcagacaagacagcaatagaagaggcaagaaaagcttacgatgccttaagtgacaatcagaaagcaatgattgaagatgcaaagacagcacttgaggaaagagaagcagaaatcaaacgcttagaagaactggcagataataccgataaaccagacccagacaataaagaggatgataagaaagacgacaacaaagataacaacaaagataacaccacagacaataatacatcaacgacagataagaataataatggttctggaacaacaaccggtacaacgaacaaaggctctaacacaaccacaggtacgacaactggtacaacaaccaataaaggtactcagagtggaagcaccaataagacaacaggaactacaactacaacaggaagtcaggcacagacaagcagcaaacagggaacagacagcagtgtgaagagtgccaagacaggagatgaaaccgatttccttcttccaatggcaggactgattagtgcttcaggtgcatttgccggagtgattctctattacaagaagagaagaaaagacacaggagtagagacaaaagaagagaaataaaaaccaattgaacactccttattagaatcccccatacttttggaagctttccagagtatgggggatttttttgtttcatttgatagcaaagcttgttttgtattgattcggttatgagcaagtagcgaagcgaattgcgaatatccgtttgacgtcgaaggtaagcaggaatggatttagtggtgtttttatttcgttttaagaaaaaattcactaaacggtcattctttttctgacaggatatggtatcataaaagaaaaaataaaagaaaaaatccgtggagtgttttaagatgcttaaaaacgggaaaggataaagattatgaataagcgggaatttttggaaacactaaaagaagcgctttctgaagagatgccggcttctttggtaagagagaatgttcaatattatagtcagtatatagatggagaagtggagaagggctgtacagaaaaagaggctgtggaaaagcttggagccccgagactgattgcaaaaacgcttttagaggcgtttgaaacgacagggcagacttatggctctgatggaaaccaaacagcgtatcaggataaatatggacggcagaatcgttcagaaggggattatggaacgacagatggagactgggcaagtgagagtattaaaaaccatatcaaattttcaaaacaggcgaagattcatctgataataggaattttaattgcagtctgcgtgattgtattgattgtcagtctgattagtgccctgcttccgattgtactgccggtacttgctgtactgcttgcattatcttatctgcagaaaaagctttaaccgattaggcaagcggcgcagcagactgtgaatatccgcttgataaaaagccggaaagggcagagaaaaacggcacagaaaactcagaaaaaatagaaaagaacaaaaaaagaaggtcttgataggggagctaccaagacctccgaggggagtataaataattaaataaggggttataatgtaaaaaaaatttttgaagggtaaattctttttacaagtgatattataatataaaaagggaaaaaaagcaatgtttttcatctttctttttagaaggttgacaaatattgtcttattgcacaaaaagaaaaaaaggtttgacagaacgtaaaaagaggcattgaaatttatgatttcaatgcctcttttgggatgtagggttaaagttttgttgtatcagacatcagaaaacgatagttgaaattccaattaaaatgccctgtgtaagaagcagtacaaggaagattggaacgatgaatttccaccatttttcaatctttacaccggcgattccgcacatgattggtgccatggcggtcggccatacgatattggaaagtccatcgccgaactggaatgccagaacagatacctgacgggaaacaccaactaagtctgcaagaggagccataatcggcatacttgtaaccgcctgtccggaaccggatggaatcaggaagtttaataaggtctgaacaacgagcattgcctctgatgcaacccaggatgggaagtagtgcagtggaatagagattccataaacaatggtatcaatgatgtgtccggattgtaatacaaccagaatacctcttgagaaaccaattatcatacaggcgactgcgatatcagtaaagcttgctgccatcttttcagcgatggtatttggtccccatcccatgataagggagcttacgattcccatgattaagaaaacagcagataagtcttcaaagtaccatccttttactttaacaccccatacaatgactgcgataccggcagcaagagtggcaagtactaatttttcacgaataccaaatgggtgattttctacttcttttgcatcaatggttaagtgactgaagtcatcgccatatacaaggctctttgtcgggtcagcctgaatctttaaggcatagcggacaacaaagatagaagcaacaacaatcatggcaaggtggcagataatacggtatccagcaccggatagctgctgtaatccggcgatgctctgtgccattccaacggtaaatgggttcataaccgcaccgctgtatccaagtccaacaccaagagcgacaattgcaagtccgacaacagcatcataacccatggcgattgcaattccaacaaaaattggaatgaatgggaaagcttcttcaaaaacaccgatggtagaagaagcacagccgagaaccagaataaaaaccggaataataatagccctcgcttttccctgaagtatttttaaaagtccggcaaccagtccgttaaaggctccggttgagataattaaactgattgcagcgtaagcgataaatacgaagaagataactccgccaccgtttaacataccattgtaaatggcttttacagtttcaaaaggtccaaccggtgaagaatcaacagtgtggtaagttccgggaacaactacttccgttccggcttcgttcacctgacggtcaaattctccggctggtaaaatccaggttgcgaccgcacagacaacaatgatagctgtcagcagtacgaagatgtgcggaagtttgaattttttcttctttttcgtttctgtacccataatcaagtcctcctcatctgctagtcagattgtttgttctttaattctttctgccatgcttcataaacagtactgcggaaagaatcgtcattaaatattttcagagataaatcagccagacaacatgcgccttttgccattgcatcgtgcgcctttggttttaatgtggcatcacggaaatctctggtatgcagtgcaaaattttcatctgtgatagaaagcatggattgcattgcaggacagcggtagctgatatttccaacgtcagaagaaccggaagccggtggtacatcacctacttttaatccataacctgccatcagttcggttattttattttccagaggataatttcttaccatatctgcaaaatcagagagtccaaaggtgagtgttaccgtacagtcaagtgccattgcagcggcatttgcacattttttaatcatttcatctactttttctaatcggctcatggaagcagtacgaaattccattcgtattttactatagtccggaataatatttggagcttttcctccatctaagataaccgagttaacatgaatatccggtgtgaagcattcccgccttgcgtcaattaaatcaagaaattttcttgcagcggagagggcacttttgccattccatggagcagcaactgcatgagcggtttctccaaagaattcaacttcataacagcgcaggcttaaaacgtccatatctggaagagaatatccgcctgaactgctgtgcatcataactgccattgacatatcatcaaagattccctgttctgccattccaatttttgcaccgttttcttcttcggcaggtgttccaatgacataaagtgttcctttgaatttatcttttaaatccattaaagcaagaccggaaagtacggagagagaaccgtgaaggttatgaccacagccatgtccgatttccggaagcgcatcgtattctgcaagaagtgcaacggacggaccatcgccgttatcaagtttggcacaataagcggtgtcatatccagcataaggataggtaacttcaaatccggcttcttttaaaatttctgccatttttcggctggattcaaattcctggtaaggaagttccggatgctcggctaaatctttgcttaaagcaattgccgtatcaagatgtttgttgacggcttctttaattttttcttttaattcactcatgggaatcaactccttcttctgtcacattacaagtgatattataatataaaaagggaaaaaaagcaatgtttttcatctttctttttagaaggttgacaaatattgtcttattgcacaaaaagaaaaaaaggtttgacagaacgtaaaaagaggcattgaaatttatgatttcaatgcctcttttgggatgtagggttaaagttttgttgtatcagacatcagaaaacgatagttgaaattccaattaaaatgccctgtgtaagaagcagtacaaggaagattggaacgatgaatttccaccatttttcaatctttacaccggcgattccgcacatgattggtgccatggcggtcggccatacgatattggaaagtccatcgccgaactggaatgccagaacagatacctgacgggaaacaccaactaagtctgcaagaggagccataatcggcatacttgtaaccgcctgtccggaaccggatggaatcaggaagtttaataaggtctgaacaacgagcattgcctctgatgcaacccaggatgggaagtagtgcagtggaatagagattccataaacaatggtatcaatgatgtgtccggattgtaatacaaccagaatacctcttgagaaaccaattatcatacaggcgactgcgatatcagtaaagcttgctgccatcttttcagcgatggtatttggtccccatcccatgataagggagcttacgattcccatgattaagaaaacagcagataagtcttcaaagtaccatccttttactttaacaccccatacaatgactgcgataccggcagcaagagtggcaagtactaatttttcacgaataccaaatgggtgattttctacttcttttgcatcaatggttaagtgactgaagtcatcgccatatacaaggctctttgtcgggtcagcctgaatctttaaggcatagcggacaacaaagatagaagcaacaacaatcatggcaaggtggcagataatacggtatccagcaccggatagctgctgtaatccggcgatgctctgtgccattccaacggtaaatgggttcataaccgcaccgctgtatccaagtccaacaccaagagcgacaattgcaagtccgacaacagcatcataacccatggcgattgcaattccaacaaaaattggaatgaatgggaaagcttcttcaaaaacaccgatggtagaagaagcacagccgagaaccagaataaaaaccggaataataatagccctcgcttttccctgaagtatttttaaaagtccggcaaccagtccgttaaaggctccggttgagataattaaactgattgcagcgtaagcgataaatacgaagaagataactccgccaccgtttaacataccattgtaaatggcttttacagtttcaaaaggtccaaccggtgaagaatcaacagtgtggtaagttccgggaacaactacttccgttccggcttcgttcacctgacggtcaaattctccggctggtaaaatccaggttgcgaccgcacagacaacaatgatagctgtcagcagtacgaagatgtgcggaagtttgaattttttcttctttttcgtttctgtacccataatcaagtcctcctcatctgctagtcagattgtttgttctttaattctttctgccatgcttcataaacagtactgcggaaagaatcgtcattaaatattttcagagataaatcagccagacaacatgcgccttttgccattgcatcgtgcgcctttggttttaatgtggcatcacggaaatctctggtatgcagtgcaaaattttcatctgtgatagaaagcatggattgcattgcaggacagcggtagctgatatttccaacgtcagaagaaccggaagccggtggtacatcacctacttttaatccataacctgccatcagttcggttattttattttccagaggataatttcttaccatatctgcaaaatcagagagtccaaaggtgagtgttaccgtacagtcaagtgccattgcagcggcatttgcacattttttaatcatttcatctactttttctaatcggctcatggaagcagtacgaaattccattcgtattttactatagtccggaataatatttggagcttttcctccatctaagataaccgagttaacatgaatatccggtgtgaagcattcccgccttgcgtcaattaaatcaagaaattttcttgcagcggagagggcacttttgccattccatggagcagcaactgcatgagcggtttctccaaagaattcaacttcataacagcgcaggcttaaaacgtccatatctggaagagaatatccgcctgaactgctgtgcatcataactgccattgacatatcatcaaagattccctgttctgccattccaatttttgcaccgttttcttcttcggcaggtgttccaatgacataaagtgttcctttgaatttatcttttaaatccattaaagcaagaccggaaagtacggagagagaaccgtgaaggttatgaccacagccatgtccgatttccggaagcgcatcgtattctgcaagaagtgcaacggacggaccatcgccgttatcaagtttggcacaataagcggtgtcatatccagcataaggataggtaacttcaaatccggcttcttttaaaatttctgccatttttcggctggattcaaattcctggtaaggaagttccggatgctcggctaaatctttgcttaaagcaattgccgtatcaagatgtttgttgacggcttctttaattttttcttttaattcactcatgggaatcaactccttcttctgtcacattacaagtgatattataatataaaaagggaaaaaaagcaatgtttttcatctttctttttagaaggttgacaaatattgtcttattgcacaaaaagaaaaaaaggtttgacagaacgtaaaaagaggcattgaaatttatgatttcaatgcctcttttgggatgtagggttaaagttttgttgtatcagacatcagaaaacgatagttgaaattccaattaaaatgccctgtgtaagaagcagtacaaggaagattggaacgatgaatttccaccatttttcaatctttacaccggcgattccgcacatgattggtgccatggcggtcggccatacgatattggaaagtccatcgccgaactggaatgccagaacagatacctgacgggaaacaccaactaagtctgcaagaggagccataatcggcatacttgtaaccgcctgtccggaaccggatggaatcaggaagtttaataaggtctgaacaacgagcattgcctctgatgcaacccaggatgggaagtagtgcagtggaatagagattccataaacaatggtatcaatgatgtgtccggattgtaatacaaccagaatacctcttgagaaaccaattatcatacaggcgactgcgatatcagtaaagcttgctgccatcttttcagcgatggtatttggtccccatcccatgataagggagcttacgattcccatgattaagaaaacagcagataagtcttcaaagtaccatccttttactttaacaccccatacaatgactgcgataccggcagcaagagtggcaagtactaatttttcacgaataccaaatgggtgattttctacttcttttgcatcaatggttaagtgactgaagtcatcgccatatacaaggctctttgtcgggtcagcctgaatctttaaggcatagcggacaacaaagatagaagcaacaacaatcatggcaaggtggcagataatacggtatccagcaccggatagctgctgtaatccggcgatgctctgtgccattccaacggtaaatgggttcataaccgcaccgctgtatccaagtccaacaccaagagcgacaattgcaagtccgacaacagcatcataacccatggcgattgcaattccaacaaaaattggaatgaatgggaaagcttcttcaaaaacaccgatggtagaagaagcacagccgagaaccagaataaaaaccggaataataatagccctcgcttttccctgaagtatttttaaaagtccggcaaccagtccgttaaaggctccggttgagataattaaactgattgcagcgtaagcgataaatacgaagaagataactccgccaccgtttaacataccattgtaaatggcttttacagtttcaaaaggtccaaccggtgaagaatcaacagtgtggtaagttccgggaacaactacttccgttccggcttcgttcacctgacggtcaaattctccggctggtaaaatccaggttgcgaccgcacagacaacaatgatagctgtcagcagtacgaagatgtgcggaagtttgaattttttcttctttttcgtttctgtacccataatcaagtcctcctcatctgctagtcagattgtttgttctttaattctttctgccatgcttcataaacagtactgcggaaagaatcgtcattaaatattttcagagataaatcagccagacaacatgcgccttttgccattgcatcgtgcgcctttggttttaatgtggcatcacggaaatctctggtatgcagtgcaaaattttcatctgtgatagaaagcatggattgcattgcaggacagcggtagctgatatttccaacgtcagaagaaccggaagccggtggtacatcacctacttttaatccataacctgccatcagttcggttattttattttccagaggataatttcttaccatatctgcaaaatcagagagtccaaaggtgagtgttaccgtacagtcaagtgccattgcagcggcatttgcacattttttaatcatttcatctactttttctaatcggctcatggaagcagtacgaaattccattcgtattttactatagtccggaataatatttggagcttttcctccatctaagataaccgagttaacatgaatatccggtgtgaagcattcccgccttgcgtcaattaaatcaagaaattttcttgcagcggagagggcacttttgccattccatggagcagcaactgcatgagcggtttctccaaagaattcaacttcataacagcgcaggcttaaaacgtccatatctggaagagaatatccgcctgaactgctgtgcatcataactgccattgacatatcatcaaagattccctgttctgccattccaatttttgcaccgttttcttcttcggcaggtgttccaatgacataaagtgttcctttgaatttatcttttaaatccattaaagcaagaccggaaagtacggagagagaaccgtgaaggttatgaccacagccatgtccgatttccggaagcgcatcgtattctgcaagaagtgcaacggacggaccatcgccgttatcaagtttggcacaataagcggtgtcatatccagcataaggataggtaacttcaaatccggcttcttttaaaatttctgccatttttcggctggattcaaattcctggtaaggaagttccggatgctcggctaaatctttgcttaaagcaattgccgtatcaagatgtttgttgacggcttctttaattttttcttttaattcactcatgggaatcaactccttcttctgtcacattctaaagtgtcaaaattcactttttgacacgcacatcataatagtaagatgattgcgtgtgttcgacgtgaatgaaaaacaattcacgtgattaaggtattgcgctatcgtattcgtgtattaaagtatacgttaattagcattatagcacattaaagtgataaaaacaagaagtaataaagaaggaatgaaaaaaatatgtataaattctaaactttttgaaatactaaggtttgtaacaaaaatcagttatgaaatcaggaggcagtaaaatggctaaaaattattcaaacaataatcagaacagtacaaataatgggatgaacgcaaacaatatgaaaaatggcggtatgcagaatcagacaaattcaacaaacagtaatacaaatgctgcacagtcaaattcacagacttcaaaaaatacacagaaaaattcaaatgcaaataacagtaaaaactgtacgcataataaaaatgcttccaatgagtatgaatattaaatcgtacagaaaataaaaaagttctaaaacaaggaacctgctgtgtgaaaggaattttgcatggcaggtttttgaatgcagataagcatttccgcgttttatcttttgtgcaggtacaaacgcaattacacttttgacatttccaacataagataaaagaaaaggaaaaataaaatggctggtatcgacacaatttcagcacagcaattggatgaatattaccgacaggatgtcgtatttattatagatttgagaagtccaaaggagtatctggaatgtcattattttggagcattgaatcttccttatgaagattttgatgaaatagagaatacaattttagagcacctgcccaaagagggactgatgatattgtactgtgacaggggaagtgcaagtctgatggcagccagagagctgatgaagaaaggatatcgggtaaaatctgtagtaggtggaatccattcatacagtggttctaacttgtatttttcgtcgatgcatagtaaaataaataaaaataaataagagcacattttatggaccggagagacagaacaaagaatcttgtctgtgagattctctgctattccggtccggctctaaaagtacataaaaaggagaaaaaagctatgaaatacatgtttgcatccgatattcacggttctgcttattactgtaaaaaaatgttagaagcttatgacaaagaaaaggcagaccgtctggttctgcttggcgatattctttaccatggcccgagaaatgatttaccgaaggactatgccccaaaggaagtcattgccctgctcaatgaaagaaaagatgatttatatgtagtaagaggaaactgcgatgcagaagtagaccagatggtattaaaattcccgattatggcagattattgcattatcatggatggagagcgtaccatttatgcaagtcatggacatatttataatgaaaataaccttccgcctttaaagaatggtgatattttcattcatggtcatacacacgtactgcgtgcggaaaagagagagacttatactattttaaatccaggttctgtttccattccaaaagaaggtaatattccaacttatgcagtgttagaaaacggtgtattttccattcgtggctttgaaggagaagttgtgaaggagattactttataatggataaatttgaattgattgcaccttgccattttggtcttgaagcggttatgaaacgtgaaatcttagacttaggatatgaaattataaaagtagaagatggaaaggttacattttcgggagatgcagaggcaatcgtgcgtgcaaacatgttccttagaacgacagagcgtattttgttgaaagtcggacagtttaaggcagtgacctttgaagaactgtttgaaaagacaaaagcacttccatgggagaattatataccggtggatggaaaattctggattaagaaagcaaattcagtgaaaagccagttattcagcccatctgatatccagtcgattatgaaaaaggcaatggtagaacgtttgaaatctgtgtaccatgtagaatggtttgaagaggacggcgcaagttatccggttcgtgtggcatttatgaaagatgaggttacgataggaatcgatacttcaggaatttccctgcataaacgtggatatcgtcaggcaatcagcaaagcaccgattacagagacattagcagcagccttaattaagctgacaccgtggagaaaagaccgcattttagtagacccattctgtggaagcggtacatttccgattgaggcagcgatgatggcggcaaatattgcgcccgggctcaatcgaaatttcttatgcgaggactggaaaaacctgatttcaagaaaatactggtatcaggtaaaagaagaagcacaggatatcatggatttaaatgtacagacggatattcaggggtatgaccttgatggaacgattgtaaaatatgcaagagaaaatgcggtacgtgcaggcgtagataaactgattcatttccaacaaagagatgtcaaagacttgagccatccaaaaaaatatggatttatcatcacgaatccgccttatggagaacgtcttgaagaaaaagaaaatcttccggcattgtatgaaacgattggagcacgttataaagaacttgattcctggtctatgtatctgattactgcttataaagatgcagagcgttatataggaagagaagcagataaaaaccgcaagatttataacggtatgatgaaaacctatttctatcagtttatgggaccgaagcctccaaaaccaaagaaaaccgtggaataagaggaaagaggataaaaaagagttatgaaacgaatgatttttgcaacaggcaatgaaaataagatgaaagaaatccgtgaaatcttaggtgcacttccgcttgaaatcctttctatgaaagaagcaggtgtttctgcagatattgtagaagatggaaagacatttgaggaaaacgcactgattaaggcaagagcaatctgtaaacttgcaggtgagatggtgcttgcagatgattccggacttgaaattgactatttgaataaagaaccgggcatttactcagccagatacatgggagaggatacgtcctatcatattaaaaataagagtctgattgaccgtttagaaggtgtgccggacgaaaagagaacagcaaggtttgtgtgcgcaattgcagcagtacttccggatggaaaagaattagtggtaagaggaacggtagagggcattattggatatgaagagaaaggtgaaaatggatttggatatgacccgattttttaccttccagaacgtggatgcacaacagcagaacttccgccggaagaaaagaacagcattagccacagaggaaatgcacttcgattgatgaaagaactgttagagagagaacgtttattataaagttcaaaaagagtggggtcaaaacttctttgaccccattacttctataatattatatacaaggaagggactcggtaaatgaagatacttattgtaagcgatacacatggccatgaagagaatttggagagagtggtagaaaaagtaggaaagattgactgtcttttgcatcttggagatgtagagggacaggaagattatattgaagcgttagtttcctgtccggtacatattgttgcgggaaacaatgacttcttttcagaactgccaagagagatagttgtcacaattggagattatcgtatcttgatgacacatggacattattatggtgtctctgtagaaaccagtatgctaaaagaggaagcacttgccagaggatgcaatgtggcattatatggtcatactcacagaccggacttggaaatcgagtcagagattacagttttaaatccgggaagtttatcctacccaagacagcatggaagaaaaccgagttatgcaattatggaaattgatgaaaagggaattgcgcattatgatatctactatttagaaagctgtaaataaaacagtgtaaattaaagcttttaaagggaaaatagcgggtattttatggaaagaaaaaaaaattaaaaaaatttaaaaaaaacgttgacatatagaaaaacctgtggtatattatatcttgtcacagggcaagagcaaaaaaaacctgagacaaaaggaaaaaaagaatactttcggggtgtggctcagcttggctagagcgcctggtttgggaccaggaggtcgcaggttcgaatcctgtcaccccgacttcctttaaaaaaggaaaacccatgcgggtgtagttcagtggtagaacaccagccttccaagctggatatgtgggttcgattcccatcacccgctttcagtatgcaatactgagtacgtgtttgtagctcagctggatagagcaacggccttctaagccgtgggtcgggggttcgaatcccttcaagcacgcttgtacagaaatgtacatataatggtgggtatagcgcagttggttagcgcgccagattgtggctctggaggccgagggttcgaatccctctatccaccttagccgtaaggcgttcttgggctatcgccaagcggtaaggcacagcactttgactgctgcattcgctggttcgaatccagctagcccagttcaaggtactaaattatggagcattagctcagtcggtagagcacttgacttttaatcaagttgtccggggttcgaatccccgatgcttcactggaacaagcaaaagcttgttcctatttttttacaattgcataggcgggcatggcggaattggcagacgcgctagatttaggttctagtgggagaccgtgcaggttcaagtcctgttgcccgcatgaaaaaaggctattgcatttaaaaatgtgatggtcttttttgtatctaaaataaaaatgtatagtttgttcaaataaaaaacaggacttattcatttcaaatttgctaagtttcgtataagataataaagagttatattacttagatgacagagggaatgataaatatgaaaacttacgatttaattttatttgccggacagtcaaacatggcaggaagaggaatttcaacagaaaaatggaacgagccagcacctttactcttagatggtgctggaatggagtatcgggcagtcagcgacccagagcatatacataaaatagaagagccatttggtgtgaatgaaaataatccaaatggtatctatgaaccaggaatgaaaacaggttctatggtgacagcttttgtaaatgcatattataaagaaacaaaagttccagtattggcagtatccgcaagtaaaggtggttcagctatctgtgaatggcagggaaatgaggattatttatcagatgccatcgaaagattggaaaaagcagttttgtatgcaaaaaagaatcaaatagaaattcggcataaatatgtagcttggtgtcagggagaaaccgatggagatagaggtactttagcagacgattacaaaaagaaatttaaaaatatgcttgaaagactaagaaaagcgggaattgagaaatgttttttggttacaatcggggaatacaatggtaaagatggatatgaagaggcatatagaaaaattcgccatacccagctggaactggcagagaaagtggaagatatcatactggtatgtgatgaatttcatacgatgaaagcacgtgaactcatgaaagacagctatcattattttcagacagcatataatgaggttggaaaagtggcaggagaaaatgcaggcagaatctccacacaagattcaagatttttcaaacaaaaataaattgtattttcaattatcgaatgctatacttcatttcagaaaaataaatatgcgaatagaaattgaaactattatttttggaggagtttgaatcatgagaatttatgtaaatgcaaatgcaggtcgtgatggaaatggtactgcaaacatgccgtttcgtcatatcaatgatgcagcaaaagtagcaaaggcaggagatgaggttttagtttctcctggtgtttatcgtgaatatgttaacccaattcatgcaggagaagaggatgcacgtatttcttatagaagcacccagccgcttggggctgttattactggtgcagagcaggtaaagagctggcagaagtatgaaggaaatgtatgggtatgccgaattgcaaacagcatttttggaaattataatccatatactacggttgtttatggtgactggtactttgcaaaggcagacaagcacacaggctgtgtttatttaaatgataaagcactttatgaggcagtttctttagaagagtgcatgaaaggtgaagtgtatgagtgcagctgggtaccggaagattctatttataaatggtacaccgagcaggatgaagaaaaagatgaaactattatctatgcaaacttccagggtaaaaatccgaatgaagaaaatgtagaaatcaacgtaagacgtgagtgctttatgccggaaaaaaccggggtaaactatattacagtaagcggatttaatattaataaagcagcaacaacatgggctcctccagcagcatttcaggatggtatgattggaccacactggagcaagggctggattatcgaggactgtgatatttcaaacagtaaatgtgccggaatttccgtaggaaaatatttagaccctgaaaatgaccattattttacttataaatatgtaaagagtccgactcagatggaacgtgatgcagtctgcagaggacagtatcatggctggttaaaggaaaacatcggtggacatattattcgccgtaataatattcatcactgcgaacagggcggtattatcggtcgtatgggcggtgtattcagtgtcatcgaggacaaccatattcatcatatcaataacatgatggaacagggtggagctgaaattgcgggcattaagatgcacgctgcaatcgacgtaacaatgcgccgtaatcacattcatcattgtacaatgggtatctggtgtgactgggaagctcagggtacaagactgactcagaacctgttacatgacaaccagaaaccggcttatgcaaagagcttaaaaggcggtatgatgtctcaggatatctttgttgaagtaggacatggtccgactttgattgataataacgtaatgctttccgatgcaagtttaagatttgcaacagagggtgttgcactggtacataacttaatctgtggtgcgctgacttgcgttggtgatggaaccggatggcgttatacgccatatcatatgccacaccgcacagaagtaatgggatttatgaccattcttcatggggatgacagaatttacaacaatatctttgttcagaaatggccgtcagaagatgtgattattccacacgattctgatgaaggatttgattctgaaaatagaaaagcaggaacctggatgtttgatgaatatccgacttatgacgaatggatttctcagtttgatttcacaaaaccggttgatatgaagaaattagagccggtacactttgggcatcttccggtatggattgagggaaatgtatacttaaatggcgcagaagcgtgcaaaaatgaagtgaatggactggttatttcagataaagaagcaaaagtggatcttgtagaaaaagagggaagctattacttagatacgaatgtatatgatttagtcggtgagtttaaagaccgcatgattcattccgatatacttggaaaagcatttgagccggaacagagatttgaaaatccggatggaacagccattcagtttgataaagactattttggcggacaccgtggcatggatgtcattcctggaccatttgcacaggcagaagatgcgaagaaagtgttgttctaatttaaaaaagtgtattcttaaataattcaatagaaaagatgaggtgttttttgaaaaagcacttcatctttttcatttctcctcttgccaaatgcacaccatgagtatataataaaacaaaaatgtgtgctttttattccaaaaatcaaatagatttgtgtgcaatgtgtaaaatttagagcaccggaggcaaaatttatggcgggaacgattcagcagattgcggaactggccggagtttcaaggggaactgtggacagggcattgaataacagaggaagaattaatccggaagttgcaaagcagatttggcagattgcagacgaaatcggatatgttccgaaacatcagagaaaaaaagaacaggaacaaaagaaaattgaggagacgtatcggattggtgtggtaacacagctttccaattctccatttatgattcaggtaaataagggaatttatgatgcagcagaacggcttttggagacaggagttcaggtgattgtaaaggaaaatccttctgtcgacgaagaagcacagttgaaatccattctggaactggaagaagcagggattcaggcactggcaatcatgccggtagactgtgatcggattcgggaaaagttaaatgacttaatcgaagaaaaacaaattccggttgtggcatttaataccgatatcattggaacaaaacggaattgttttgtgggactggataactggaagagtgggcagaccgcagcgggactgatggggcttatgatgcatggaaagggaaaagttcttggaattaccggatatttttcgaaccgtgccggcagtagaagaattgatggatttatagaggaaaccagaaaacagtttccggagatgaacctgattggcgtgcaaagcagtcaggacgatgcaaaagaagtagagcagattattgtaaatgcaatgaagatattcccagatttgaagggaatctttgtggcatccggcggacaggaaggtgttaaagctgcatttgatgaattgaatctggaaaaacgcccttatgtgattatctatgatgtgacaccggaaaatgtaaaagcgttgaatgaagataccgtggatttcctgattgaccaggaaggatacgagcagggttatcgggcagtatctatcttagaagaatgtctgaaacacggcagtctgccggaggaagagtatcagtacacggaaatcagtattaaaacaaaatataatgtgcaataaagaaaatagaaattagcaaagaactctttttgattcataaaaaagggttctttttttgttgtgaacaaaaaacacgcataaaagcacacaagaaactagtaaaattgttataaaatcgagcctttagattgtgcagaatatcgaaagtgtgcaaaaacaaaaaaagcacttgtaaaatgcgtgtgcaagtgctactataaagccagaaagagaacacgtgaagcacacaaacgaaaataaagcacgcacacacatagtaaaaatagtaaaaaaggaatttgggaggacacttttatgaagtatgtagaatttgatgaaacaagaccaatggatttggttttactgggacgtgtcgcaattgattttaatccagcttataacgaccaagtgaaagaagaatttaaaccactgaaaaaagttcatatgtttgaaaaatttgtaggtggttctcctgcaaacatcgcagtcggagttacaagacatggactgaaagcaggattttttgcaaaggtatcagatgaccagttcggagaattcgtagtggactacttcaatgagcagggaattgatacttcccacatttcaaaatgtacaaatggagaaaagttaggactgacctttacagaaatgctttctccaaaggaaagcagtatcctgatgtatcgaaactgtattgcagacttacagttaagcgtagatgacattgatgaagaatacatcaaacagacaaaagcaattttaatttccggaacagcacttgcagaaagtccttcaagagaggcagcaatcaaagcagtaatgctggcaaagaaaaacaatacaaaagttatttttgatatcgattacagagaatataactggaagaacagtgatgagatttccatttactattccatcgttgcaaaagaagcagacatcatcatgggctcaagagaagaatttgatttaactgagaaactgattcagccaggtatgagtgatgaagaatccgcagctttgtggcagggttacaatgcaaaaatcgtagtaatcaaacatggtatgaaaggttctaccgcttatacatgtgacggacagaaattttccattaaaccattcccggtacaggcaagaaaaggatttggcggcggagacggatatggttctggattcttatatggattatatcagggatggcaggttatcgattgtctggaatttggttcagcagaagcatccatgatggtaagaagcaacaactgttccgattcccttccgggaccagatgcagtacacgcatttattaaagaagaaaaagaacagtacggcgaaatgattgcgagagtataaaaaagacgaggcaaaggaaggagaatacaaaatggcagagacaacaagaatgacagttgcacaggcaattgtaaaatttttagataatcaatatgtatccatggatggagtagaaacaaagtttgtagaaggatttttcacaatctttggacatggtattgcagttggacttggtgaagcgctggataccaacccgggacagttaagagtcatgcagggcagaaatgaacagggtatgtgccatgtggcgactgcatttgcgaaacagaataacagaaaaaccattattccatgtgcttcttctgtaggacctggagcagcaaatatggtaaccgcatgtgcaaccgcaaccgtaaacaatattccactgttagtatttccggcagatacttttgcttccagacagccagacccggtacttcagcagttagagcagagcaacagccttgcaactactacaaatgatgcatttaaaccggtttgcaaatattgggacagaattacacgtccggaacagttaatgacagctttaatcagtgcaatgagagtactgacagacccgacagataccggtgcctgctgtatcgcacttccgcaggatgtagaaggtgaatcttatgattatccgaattacttctttaagaaacgtgtacacagaatcacaagaccggttgccgtagaagaagagttagaagatcttgtggaaattatttctcaggcaaagaaaccacttgttattgtaggtggcggtgtaaaatattctgaagccggagaaaccgttgaaaacttctgtgaagaattccatattccgtttggtgagagccaggccggaaagagtgcctgcaaatccagtcacccatactgccttggcggaatcggtgtaacaggaacactggcatccaatgtgattgcaaaagatgcagatgtagttatcgcaattggttccagactgtctgactttacaacaagctcaaaacatctttttcagaatgcagatgtaaaatttgttacaatcaataacaaccgttatcatgcatacaagatggacgctgtaaaggcggtgggcgatgcaaaagcaacggtagaggcacttgccgaaaaactgcgtgcaaaaggttatgtttcaggttataatggagaaatagaagcagcaaaagctgcatgggacaaagagtgggatcgccttgcaggaatcgagtatacaggagatgactttgaaccgattatcaaggcaagagacccgagaacagttccggaatttgtaaaattaacgaacggaaaaattacacagactgccgcacttgcagcaatcaataaaacaattgataaagatgcaaccattatcacagcaggaggttctcttccaagttgtatgcagcgtatgtggagaacagacaagagaggcggatatcatgcagaatatggttattcctgcatgggatacgaagtggcagcaactcttggtgtaaaattcgcagagccggataatgaagtttactgtgttgtcggagactccagtttccagatgcttcacagcgaaatcatgacgattatgcaggagagaaagaaagtaaatattttaatcttcgataactgtggatttggatgcatcaacaatctggaaatgaaccatggtatcggaagcatcgcaacagaattccgttacacagatggaaagaaaccgacaggagatttaattccggtagactacgcaaagattggcgaaggatacggattaaaaacttatacatgcaaaacaatcgcagaacttgtggcagcattaaaggacgcaaagaaacaagaagttgcctgcctgtttgacctgaaagtaattccaaagacaatgacagacggatatgaatcctggtggaacgtaggaatcgcaacaacttctgaaaaagaaagcgtaagaaaagcttgcgaaggtgtaatggaaggacgtagagaatccagagcttactaagatttcaggagtcatgtacgcttgaacaaaaaagtttaagcgtacagaagtacaattaagtacaattaggaggtaaagacaatgggtaaagtatttggctatccagaatttgacgaaaacggcgagaaaattttaacaacttatgacaatgactataaagaaatgatgatggacattcgtgtgtatcgcatgaaagccggtcagacaagaaccttcttaagaacaggtgaggagactgcagttctgcttctctctggaaaaatcacttatgaatgggaaggcaatacagaaacagtaagcagaaaagatgtgtttaccgaaggtccttggtgtgttcatgtatgtaccggaaaagaaataaaagtaacagcagagaccgatgcagaaattcttgtacagtgcacgaaaaatgatgcagactttgcaggaaaattatataaaccggaggatgctccatggggttattcctgtgttggcaaatttggaaatgttgcaaagagaagagttaataccattttagaccatgatattgctccgtattccaatatggtactcggagaagtattaaatgacaaaggaaactggtccggatatcttccacacagacatccacagccggaaacttattatttcaaatttgaccgaccggaaggatttggtgcaagtttcgtaggagaccaggtatttaagagcacagacggaagcttttccgcaattccgggaggagagttacatcctcaggcagttgcgccgggattccagatgtatacttgttggatgattcgccacattgacggaaatccatggttacagacagatcgttgtgaagatgaaagatatacatggctgcatgatgccgaaatctaagaatgaataatagatttatttgataatttaagaaaaaaaagaacgttaaaataaagtaaaggaaaatcaagaaactaagtttagaaaggatgcgtgttattatggcaagagaatttatcgtaccgggacagattatcacaggttcaggggctttaacaatggcggaggaaactttaaaaggacttgggaaaaaagctcttatcgtaacagataaagtaatgattcagttaggaaactgtgcaaaagtagaaacagctttaaaaaatcagggaatcgactatgcaatttattctgaaatcgttggtgagccaacggatactatgattgaaaatggtctgaaagtatacaaagaaaatggatgtgatttcttagttgcattaggcggaggaagtccaatcgactctatgaaagctattggttctttagttgtaaatggtggaaatatctccgattacatgggaaaagtaattgatgtagaaatgccgccgcttgttgcaattccaacaacagcaggtaccggttctgaagcaactcagtttacgattatcacagataccaaaaaagatatcaaaatgctcttaaaaggtaaagtattaatgccaaaactggcaatcattgaccctcagtttacaatgacagcaccgcctaaaattacagcagctaccggtcttgatgcactctgtcatgcagtagaagcttacacatcaagaaaagcacagacactttctgacagctttgcaatgtcagctgtaaaacgaattttcaaatcccttccggttgcatttaaagatggaaaaaatgaagaagcacgtatccagatgtctgttgctgcattagaagctggtatcgcatttaacaacgcatctgttaccattattcatggaatgagtcgtccaatcggtgcactgttccatgtagcacatggtctttctaacgcaatgctgatgaaagaatgtttaggctttgcgttagaaggtgcttatgacagatttgcagaccttggtcgtgcaatcggtgttgcagatgcaacagatgaagacaaagcagcagcggaaaaattcctttcagcagtcgaaggaattgtaaaagaattagagacaccaactcttgcagagtttggaattgataaagaagagttctttaaagtaattgataaaatggcttacgacgctatggatagtggaagcccacagaacactatgcgtgaagtaagcgaagaacaggtaaaacagatttacagaaatctctggtaatcgtctatgaaaaaacggcagataggaaagctgggactggttctgcttgcaggaatccttatggcgggatgtggaaagacaaaagaagaagcaaaagcgccaaagtataccattggagttgtgaccaagtcaaaaagcagtgaatattggatgtctgtctgttcgggaatggaagatgccgcagaaaaagaaaatgcagaggttgtgattttgtctccggattcggagacagaccagaaaacacagaaaaaaatgataaaggatttactgaaaatgccgattgatgcactggcagtgtccactgtgaattcttacgacaatgcagattatattgagctggcgaaaaacaggggaatcgaagtgtatgcttacgatacccctgtttctgacgttgttttaccttacgttggaatcgatgacgagaaggtaggatatgaacttggacaggcaatggcaaaaaaattaaatggaacaggaaaggtggcagtcatagcaggaagtaccacacaggcctgtcatgaaaagcgtattttgggctttaagcgttgtatggaagaataccctgatattcagatagaagttgtaaaaaccggatacagcaatcttttggtttcggagcaggatatgaaagaattattagaagagtatccggatttggatggaatcatgacaacaagtgcggtgacggcacttggagtggcagaggcaacgaaggaaagcggaattttggttgtcacagtggatgcacaggaagattccattgaaggagtgaaagacggaaagtttcttgcggtaggcgcacagtccggatatgatatcggttatgagacaattgaatatatgatagaaagtttggaaaaaaacgaaataccaggtgaaaaaatattggacacaaaaatattgacgatagacaatatagatgagtactcacctaaaaaaaagacacaaaatataaaaaaatcgcaatcagaaagttaaaagagcaaagtttcctaaaaaaggggactatttttaggaaagaagagaggcggatataaaaatagcacaataaaacccaaaatttctaagactgggattttccctgcaaaacggtaaaatagaatcatcagatagagaaaatgcgaaagcaaaaaagcatcttatgatttgaacgcagataagcattcctctgcttcaagtgtgcggagcactaagcggtgggtaagggggatgcttctgtcagtgggagtcaaaagctcccattgacagattgcgaagcgactgcgttcatgagcaagcagcgaagcggattgcgaatgtccgctttactacgaaaggtattctcgaaaaagaaaggcagggaaatgaaatggcaaaagaaatgacacggacgaaatcagtcacagcagatgactggtcggcaaggtcgaaaatgatgaccgtgatgaccgcacagaatcagaaacttggatggggaacaagagttgcctacgcaagtggtgacgtagcctgtaatgttgtatttggaatggttggtaccttattaaccttattctatacggattacgcaggaatcaatcctggtacggttggtttgatgatgctcttatcaagattatttgatggtgtgtcagacttgattatgggaattattgtagaaaaaacaaattcaaaatggggaaaatcaagaccatggattttatggatgagtgtaccatttgctttatccgcagtactgttatttacggtaccgcacaccaccccgatgttacagtttttatatctgtttgtaacgtataacttctgtactacagtttgttataccgcaatcaaccttccttacggaagtctttcagcaatgatgacaagagtttccggagaaagagatatgcttagtgtggttcgtatgggattatctccaattggaaaaatcgttgcagcaacctttactcttccgattgtaaaaatgtttggagatgaccaggcggcatgggtaaaaacaatgagtatctgggctgtacttgctttaatcttattattaatctgtttctttaactgtaaagaaactgtatacattgaagcaaaagaaaaagcagaaaaagtaccgcttggaaagtccttgaaagcattatttacgaatcagtatttctgggcagttttagttttgtggatggttcagagtgtttcctttagtatttcaggaacaatcttaccgtattattgcaaatacatttttggaaatgacacatggatgtacagtgcattattcttgacagaaacattaacactggtagcaggaattttcctctgtgcaccacttatcaaaagatttggcaagagaaacattgcacttgcaggttctgcaatcgcattagtcggacagttattattcttcctgaatccatacagcttttcttggatggttatgagttgtgtggcacgtgcaattggtcttgcaccgctgaatgcagttgtatttggaatggttggagatgttgtggaatatggacagtggaaaacacatgtaagacaggaaagccttatttttgcaggtggttctattggaacaaaggttggagcaggtcttgcatccgcagctatgactggattgttaacttttgcaggatatgttacttcttcttcaggagttgcaacacagtctcaggaaactttaaatatgattattaacatttataaatttggtccaattattatcgcactgcttgcatttgttacactggcactctacaagctggacaaaatgtatccggatattatgaaagagctgacagaacgtgaggcaagaggcgaactttaatgaagcttaaatgagtgaaagaaaaaaggtatcggaagttttccgatacctttttgtgttagaaagaacaaagcacaacttgcgggcattttgtgctataatcaaatcaaaagtaaaggattttaatctatgaaacagagtatccgcaaaaaagtactgctggcaatcttgctggtgacgattcttacaagctgttgtattacggtcgtattttatttccgcagtgcatcaatgattgagaaaaattatacagaaaccgtctactcgagagtccggcagactatggaaagttttgacaattccatgaaggaattatattataaaaatattgagatggccggaaaagaagagctgcaaagagaaattgagcaatatcgggaaagcaacaatgcagatgaattggagagtcttgcagaaattttgcgtgcctgcaaaaaaaatgaggatcgtctcagttcaattgatttgattttacccaaagaacagattgcggtgacttctgaagattttccggtttataaaagggaaattccaaaagaagagattcagaccataaaagagatggaagaaaaaacggcacgaccggttatggtaaaaaacagcgtgcatgagaaccggactcaggttacagagattcagccaatctacgatgaagaacaaaatattcttgcgtatttattattaaacgtagaagaaagaactctttattatcaatacatagacccgatttatgatgaaaatatgaaccaggctttggtttatgatgaaaatgaagtagttgtcacagggatgaattccaaagaagccggaaaagcgtgtgcagaagagatgtgtctgaaacagaatgggatttttcaaaaagaaaaaggagtaattgtgattggctataaaggcgcattttccggctgtcagctttctattgcggtgcaaaggaatgcaattttgcgccaactccgtcagatgcagatttttttgattgtaattgtgctggtatttttatttgtggcaattgtgcttgcaggcagtttgacgcgtgcaatttaccgtccgataaaaaagctgaccgatacggtggaacaggttggagagggagatttgagtcttcgtgcggaggtagaaaccggagatgaaatcggaatactgtgtcgggaatttaatgtgatgcttgatgatattcaggagttaattcaaaaagtaatcgaagaagaacgattaaaaaaagatgcagaattagaagcacttcagtatcagattaccccgcattttatgtataatactttaaattcgattaaatttgcggcgttgatccgtggggaaaaggagctaggtggtctgataggagattttgtggagctgcttcaagcgactatcagcaagaaaggtacttttttaacggtagcagatgaatttcatattttaaataattatgtgcatctgcaggaatttcggtatcagggaagttttcgtgtgcgttatgagatggaggaaggcgccggaggttgttatattccgaggttgattttacagccccttgtggaaaatgcaattcttcatgggattgacatgaaagaaaaaaatggagagattattttaagagcaaaattagagcaggatcgattacggctgtttgtcattgataatggcagaggcatgacaaaagaacagattgatacgctattgcacagcaaaactaaaaagaccaatggtttaagtgcaatcggagttccaaatattaaagagagactggaactttactatggagataagggaggaatggtctatcaaagcagtgaaaatggaacgactgttgagatttttctccctgcaaaaaaagaattatgaataagtccccgtccactgcttaatgattttggtgattgaagcagggtacttgacttatttgattcaactaaaaacagactaaaatacaggtggtgaagtgatgtttcagacattattagtggatgatgattttcttgtaagaagttatttaaaaacacttgattcatgggaaaaagagggatatgaagttgtacgtgatgtacaggatggggaagaagcccttgaagtgatgaatcaggaaaaaattgatattgttgtgacagatatttcaatgccgcttatggatggaattgaattaattaaggctgtaaaaaagaactggccggaagtttctgtgattgtgcttagctgtcatgatgattttgaatatgtaaaagaagcaatgcggcttggtgcagatgaatatattttgaaaaacaccttggatgaaaattcacttttagaagtattagagaaagcgaaggctcaaatagaggcaaaaaaggcaaagactacacaggagaaacatacaaaaaaactgattcagatgggcagtcatacattaaaatatcatttctttaatggagttctttctcaaattttagagggagaagtgcgggaacagaaacgtctggaagcgcagatagcaggcagttataaaaacagtgcggtgattgcaatgtttatgcatgactggaatcgtcagaacagggagtggacaccactggaagcggaacagtattcattggaatttcggacgggaatcgagagtgaaatcgaagctgtgttaggcgaagaaaatgaattaaaagaaattatctatctgggagccggaattttctgttgttttctggatttatcagaaatgagaagagactctttgatgcgccagagactgacagatgttgccggagcctgttttcgattttgtaaaaaagagtcgtattcctttggaatcagtgtaagcagtatctgtattggagtacaggatggacttcgtcaggcatatcagcaggcaagacagatgatgaaatatggattttatgacagagacagcattttgtactatgactgtcaaaaagaagtttcaagagagcttccaaagagtgcagaaaagctgattcatcaggttcagaatcaaacagagaatacagaagaagaactggagcaagaggctgtgacacttatttctgaggcaaaacagaagatgacggatggcagaattttagttcagtggcttcacaaattggatgaaagtgcatacattgagcgaagtgcacaggtgtatacggagattgcttcgattgaacaatttaaaatggctttagaagaaagcgtgcaggaagtctgtaagcatagcgaagaggagattccagaaggggtttctcatacgataaaagtggtgctcttgtatctgcatcagcattataaagaacaaatcagcctacaggatgtggcagaagaagcaggagtgaattcggcatatttaagttatttatttaaacaggaaatgggaatcggatttgccaattatctgcaggaatgtcggatgcgctgtgctgaaaaaatgctctgtgacacgaacttaaaaatcaaagaggttgcagaggcagcaggatttaatgattatcattatttttctaagatttttaagaaataccaccactgcagcccggcggattatcgcaaaaagcagtaaaaaaaagagatgcacttgtgttgttcaaagtgcatctctttttggttttcgttaccgagtgtacggtatcattgactttcagataaataacgcagcagatggaaatttatccaagttattttattttcccaagatttcttttaatgcctgtaatacttcatccacatctttttcatttgcactttctcccatatgcccgatacggattaattttccaccaaagcatccaaaagagccggcaagcagaatattataatcgtttctcatttttgagagtatttctttatctgtaaaaccttccggaacttcaaacgtagtaacggtattagaataaccggagtgtggatataaggtcagtcccatttcttttaaagtggttctggtcttttcggctacttttgcatgacgttttaaatgctccggatcatttttgatattttcaagtgcctgacgcagaccatagatgtcgcttgcaggcatggtataagggaaccacttttcttcatagtaatgttcaaatacttttaagtttgcatagaaagaagcaattggtgtcttacgctgattcatgacatcttttgcatcctggctgatggtaacaatagtcagtcccggaggtgcggaaattgctttctgagaaccaccacataaaaggtcaatccggtaatcatcggctcttacttcttctccgaacatcgcagatacggaatcgacaacggtgaggattccataggattttaataatgggcagattttagaaatatcgtttaacataccgcttggtgtatcgcagtgcacgactgtggcatatttaaaatcgtgctgttcttttaagtattcggcaagtttttcagggtcaaccggcttgtcataatctacggtatagagagttggaatgccgccatacatggttacgaaatctttaaaagattcaccgtaaagtccattatcaaggacaaggacacggtcacctggttcggtgatagaagcacaggcagcttcaagaccgaggattccctctccatcaagaattaaagtttcatttttggtgtgtaagagttcacttgccaaaaggcaggtctctttgtagtattcacagaaatcggcatctaaatccggattttgaaattccaggcttcttgccatgcgtacattttcccgtacctgagtcggacctggggtcatcattttatacatctgtttacgctcctttataaattattttttgagttttttattttacgagtttctgaagacgtccgattaccagtaaaacgataacggctgcaacgccaatctgaaccagatttcccggaatagaagcaacaggagcagcccagtttccatagataaagccttcggcgatatagtaacctacgactttaatcacacaggcaactgcgattgcaaggacattccatccaaagccttttcttttttcggtaatggcgccgactgcaaatcccatcagtcctacaattacaagagtaaatggtgcccatgcagtccatccggacagtaaatcaaataatcccattccgacaccgcctgcgattgcaccggttttcttgccaaataaaattgcaccgatgaaaagcggaacatttccaagatggattaaaccgccgtttgcagcgattggaagtttgatgtttacaaatgcagtaaatacataagtcaaagcgataaacattgctgtaattgtaataaagcgaatctgtgaactggttgtctgtttttcggcaaccggaatggctgtattacttttttcaatcattaaatttttcctctctttctctctgtcggtactcgcaaaatcaaaaacaagaagattctgagagtacacacgattcatcttatcttgagttttaagtatcataacgaaaaacaggcttgcttaaaatagccagttttctaaagttttaccagtccagttgcgtttggaacatttgccaagaggaatggaatgtggtacaataggagaaaattttgcgtgccccagaacgtagagaagaaatgaggaaaagaaaaaaatgggtgtaacaatcaggcagattgccgaggcagcaggggtgtcaagaggaacggttgacagggcgttaaataacagagggcggattcgtccggaggtggcagagcggattcaaaaaattgcagaggaaatgggatatcgcccgaaccagcttgggcgggcactttcgatgagtaaaaataatattaaaattggagtgattgttcaggcatgtgagaccccatttatgaatgatgtgttagaaggtgtaaaaaaagcgaaagaagaagtagacaaccttggaggaacggtgattgtctgcaagattccacatatcagtgcttcggacacaattgaagcaatggaagagatgcgaaaggacggagtcagcgcaattgcaatggttccatcggatgaagaggccgtcaaagaaaaaattcgtgaatttacaggagtctatcagattccgatagtgacatttaactcagatgtgccggataccggaagactctgttttgtcgggcaaaatggtattcagtgtggaaaggcagcagcaggtctgatgggagaattggtaaacggaacgggaaaaattgccattatttccggatatcggacgaacccttctcttagagaacgtgtggatgggtttacaacacagataagagaaaagtatccagatgtggagttggtcggaccagaatattgttttgaagaaaatgaaaaagcagagaaaattacagaggaaatattaaaagaaaatccggatttgaaagcaatttatatgacctcccatggagaatcgggtgtgtgtatggcattaaaaaagaaaggcatggcaggaaagataaaaatgatagccaatgattttatgggggaaaactacaggctcatgagagaaggttatattcattttttgattggacaggacgcttcgattcagggttacgaaccggttatgattttatttcgtctgctgtttcatgcagaagaaccggaaaaagaattaatttatacagaaatttatatccgaaatgaatatacgattccggaataaaaataaagtagaataaaaacaggaggattattatgagtatcaaagaacagattcatgatttatcagatgaaatgataacaaatattggcagactggttgcgattgattcccagcttggaatgcctggagagggaaaaccgtttggggaaggaccggcagaggcactgaaagaaggactgaaaattgcagaagaacttggatttaagaccgtaaacttagataattattgtggttacgctgaaatgggagagggagaagagattgtcggaattgccggacatcttgatatcgtgccggttggcggagactggacttatgacccatttaagctcacaagagagggcgattatatctatggacgtggaacgacagatgataaaggtccagtcatcgaggcactttatgcgatgaaacttctgcgtgattcgggtgtgaaactaaataagagagtgcgtcttattatgggatgtaacgaagagaccggttcaaaatgcatggaacattataatgaagtcgaagaggagttatcctgtggatttacgccggatgcaaatttcccatgtattcatggtgaaaaaggtcatatgtccatggtggcatattcaaaaaatacaaaaattatttctatgaatggcggatttgtttcaaatgcagtctgcgatgcgtgtacaactgtgattccggcagaagcgggattaaaagaaaaattagaagaaattttagcaaagacaaagcttcaggaatatcaagtgaaagaagaaaatggaacaatccgtatttatgcaaaaggagttccggcgcatgcaagcacaccgacacttggagtgaatgcagcaggagcaatctttgagagtcttgaaaaagcaggatttgaagatgattttgtgaaattttataacaatcatatcggaatatcctgtgatggatctggaatcggattaaaatttgaggatgaatacggtgatttgactttatgtaatggaattgtcaaaacagaaaatggtgtcatttcctgtacgattgatattcgagttccggtgaccttaaaagcagaggatgtgcgtaagatgtgcgaaggaaaacttgaagatgaaaacggacgaattgaaattcttgaaatcggcgacccgttgttcttcccaagggagtctccgcttgtcaatgcgctctataaagcgtatgtggatgtgacaggtgataccgagaatgaaccgatggtaatcggtggcggaacttatgcaaaatcccttaaaaatattattgcatttggaccggagaaactgggaattgattatcggattcacagtgcagatgagtatatgctggtttcgggtatggaagaagcggtgctgatttatatggaagcaattaaaaatcttttggagatttgacagaaaagagagacgtaatatttatgagagaatcggatgccggatggacattatgaagatattattccgcattattatgtgttgtaaaaacaggagagaaaaacaatggtaaaatcaattatgagagatatctttttcttaaatcaaaaatcagagccggcaatgaaagaagacattcagacagcagtggatttgctggatacattaaaagcccatgaggatggctgtgttggcatggcagcaaatatgattggggtaaagaagtgcattattgcagtgaatatgggatttttaaatgtggcaatgcttaatccgaaaatcgtgaaaaaatctggaaaatatgagactgaagaaggctgtctgtcccttgaaggggtacgaaaatgtaccagatatcaggagattgaagttgagtatgaggatatgaattttaagaaacagaggcagaaatattctggatggacagcacagattattcagcatgaatgtgaccatttggaagggattattatttaaccaaatcaagcaagtagcgaagcggattgcgaatatccacttgactcaggtggtagcagggaaaaagttttattcctgctacctattgcattataaaaatgattttaacacttctaacactccactttcccagtaaggtgcacaggttgatttcgccgcttcgattacctctggacgggcattggaaacagcatagctggttccggcattttttaacatttcaatgtcgttgagattatcaccaaagcagcagatttcatcagcattcagttgatatttttccattaaaaaggagatagcagtccatttgcttactccaagcgcattgcagtccacccattcttttccggcaactgcaagctgagctttttccttccaggaaggaatgaaaagaggagtacacatttcttcacaggcagttggatgataaatggtaaatttaatgatatcctttgattctaatttagataagtcatcgatttctttcatttcaaacccataagaatctcttaaccagtggaacatctggctgcctccatcttctgcaaaacagtaatccggtgtagcggcaaaacagtcacaggatggaagtttttctttaaccatctgatacatatttttccaaagttcatctgacattggataagtttttaagatttcatttggggtgcggacgacggttccgccatctgaaatatataacagtttgtctttgattgaggcaaagagtttcttttcacttgaaaactgacgaccggagcagacaacaaacagaattcctttctgggttagctgttcaatcacggtcatgtactccggattaatcatgagagttccgtcttttactaaagttccatcaatatcagttgcaattaattttatcataagaaaaaatcctccaggaaataagataaagctatacttaaagataattataagtgagattttattttgatgcaagaaaaagggtggttcggttttggtaaaatttatagtgaatctgtacaaaatccattgataaaaattataatttttgtcaatggattttttttgaacggagatatatacttaacttacaattaagatataaacataagtgaaaagtaaaacttgatgcaagataaaattaaggagaaaattacgacatgaaattaacaatggatgggatcaaaaatcgtgaagcatgggagaaagcaggaattcagcttccgggatacgatgtgaaagagatttcggaaaaagcaaaaaaagaaccaagatgggtacactttggaatcggaaatattttccgtgtatttatcggtggaattgcagatggtttattagaagaaggtgcattagactgtggacttacctgcgtagaaacatttgattatgatgtagtggataagatttatactccttatgataatctgggcttaagcgttattcttcatggagacggaagtcgtgaatataaagtgctgggttctctggcagaggcagtaaaagcgcagtcatctaatgagacacagtggaaccgtttaaaagaaatttttacaagtaagtcgttacagatggtttcttttacaattacagaaaaaggatatgcattacagaaagcagatggcacatggttcccattcgtacaggctgatattgaaaatggtccggataaagcgacaggagcaatggcagtagtagtggcaatgttgtatgaaagatacaaggcaggaaaatacccattggctttggtttccatggataactgttctaaaaatggtgcaaaacttcgtgaatctgtactgactatgacagaagaatggaaaaaagcaggatttgtagaggaaggatttgtttcttatgtcagtgatgaaaaagtagttgctttcccatggactatgattgataaaattactcctcgtccgagtgaaaaaattgcagatgatttggaagaacttggcattgaagaaatgcagccggttattacaagtaaaaaaacttatattgcaccgtttgtaaatgcggaaaaaccacagtatctggttattgaagacaatttcccgaatggtcgtccggcactggagaaaggctttggtgtttatatggctgacagaaatactgttaatttatcagaacgtatgaaagtaactgtatgcttaaatccggtacattccgctacaggacctcttggagtcgtacagggatatgacttatttgcccatatgttaaatacaaatgaagacatgatgaaaatggcacgtatggttgcttatgatgaaggacttccggttgtcccaaatcctggaattctctctccacaggcgtttgtagatgaattattcaatgaccgtttcccgaatgaatatttaggggacaccaatatgcgtctctctgttgacgtctctcagatggtgggaatccgttttggagaaaccatcaaagcttatgttgaaaaatttggagatgcaaaaaaactgacagcgattccactcggaattgccggatggcttcgttacatgcttggagtggatgatgaaggagaaaaatatgaattagctccggacccaatgaatgaagaaattcaggaacagttaaaagagattgtaatcggaaaaccggagacatttacagaccagttaaaaccgattctttctaacgagcgtctgttctttgttgatttgtatacaacaggtgtggcagaaaagatagaagaaatgtttagagaaatgattgcaggaaaaggagcagtaagagcaaccattcataaatatgtaaatcagtaatagaaaataatagaaagaatcgattcaaaaggtgattctccagaaggtggagagtcaccttttttgtacagaaagatttactcagcatacactataaaaaatggaaaagaaaaaagccaaatggaaaatcaaaaactggaaaatctattaaatctggcattgaatgccacaccggaggaattggaaaaatcagaaaatttatcggttggttatgaaacagaacaaggaaaatgggaggtaattgtaaaatattctggagaaccggagatttttgaaaatccggaaatccagaccgtaaggcttttgggaggttttgcaattttaacgctttcacaaaatcaaatagagagattggcaaatgacgcaggggttgaatttatagaaaaacccaagcgtttattttttgccgtaaatgagggacgatcggcttcttgtatcaattcagtgcaggatgagtcttttttgcagggaaattccctgtttggagagggagttctagttggatgtgtggattcgggaattgattacagtcatccagatttttgtaatgaagatggaaccagccggattttgcggctttgggatcagagtgtatcgggaaatccaccagagggatatgagattggaacggaatatacaaaagagcaaatagaggaagcgttggcaaaaaggactcccgcagagcggtatgcggttgttccgagccgagatttgagcgggcatggaacaggtgtgatgggaattgcagccggaaatgggagagcgtcaaaaggagtctatcggggagttgcacccaaaagtgaattgattgtggtgaaacttggaaatccaagagcagaaggatttccgagaacaacggaattgatgcaaggaattgattactgtatcaaaacggcagtcaggcttggaaaaccacttgcgttaaatttgagtttcggaaataattatggttcgcatgatggagaatccctgcttgaattttatctggataccgtggcagttatcggaagaaatgttatctgcgtgggaaccggaaatgaaggaaataaagcaacgcacacttcgggagtactgggtaattcaaatgaagtcgttcccctgcaaattggagactatgagcggagcatcaacctgcagatttggaaacagtatgtagatgagatagagttttctttggaacacccaaatggagaggttgcaggaccatttcgggaagagcttggaacacagagatttcgtctggaaaacacagagattttgatttactatggagagccaaagccatttagtacagcacaggaaatttatctggattttattccggttaacacttatgtggataccggtgtctggaaaatcaatctgattccaaaaagaatcgtagatggaacgtatgatatgtggcttccatcgggaagtgtgctcaaccaggggacgagatttctttatccaatgccggagacaacgcttacgattccttccacagcacagaaagtggtttctgtcggagcttatgattccagatatcaggcagttgcagatttttcaggtaggggatatacaagagaaaaccgtctgataaagccagatatcgcagcaccaggagtaaatattatgacaacagcggtgggagggggatatcggacacagagcggaacttcctttgcaacgccatttgtaaccggaagtgcagcacttttaatggaatttggagttgtgagaggaaatgacccgtatttatatggagagaaagtgaaagcgtatttgattcgaggagcaagacatttactgatagaaccgtatccgaatcaattgttggggtggggagcgttatgtcttaaaaacagtattccataaaaccaaaagaagcaaaaatcttaaaccagaaaacacagtcacctttggttttctggtttgcgtttctttgtgttagatgataaaattaataagaaatataaagagggcaggttaaagttatgacaaaaatatggaagaagatagtagtaatttggctcatagccgtaatagtattacctttaatgacaggcatgcaggtttgggcaaagacagagccaaaacagcttgatatattgtttacccatgatacgcattctcatctgaacagttttacaacaatagtaaatggtgagaaagaagaggcaggcggttttgcaaaattaaaaacattgatagatgagcataagaaagtgaatccagatacacttgtactggatggtggagatttttcaatgggaacactggttcagacggtatatgacacagaggcagcagaacttaggatgcttggtcagataggatgtgatgtgaccacattgggaaatcatgaatttgattatcaatcaaagggactggcagatatgttgaatgcagctaaaaattctggtgatacagtaccgagtctggtattgtgtaatgtagactgggatgcaatggaagaagcaggtttaagtgaaggtcaaaagcagatacaatcagcatttgagaaatatcaggtgaaggattatgtagttgttcagaaaggtaatataaaaatagcggtacttggtgtatttggaaaagatgcacttgtctgtgctccaacctgtgaattggtatggaaagacccagtgaaagcggcaaagcaaacagtagaaaaaatcaaaaagaaggaaaaggtagatatgattgcctgcgtgtcccatagtgggacatgggatgaggcagacaaatcagaggatgagattctggcaaaagaggttccggatattgacttgattattagtgggcatacacattcacaattagacaaaccaattcagcatggaaatacatatattgtatcctgcggtgaatatggaaaaagtcttggaacaatttccatgacacaaaaggatgatggacggtggaaggcaacctcttatgagctgattccggtatcggatgaagtgaatccggatgagacaacacaggcaaaaattgatgcattaatggatacggtagatataaattatcttgcaaagtttggatatacaagaaaagaagtacttgcagaaaatgatattgaatttaatagtctggatgaaatgagcacgaggcatgaggaattaaatcttggtgatataatatcagatgcttatgtatatgcagtggaaaattcagataactacgatggagatccggtagacgtggcggtagtcccaagtgggacggtacgggatacttatgcgaaaggagaaattacggtagaagctgtctataattctttttcactgggaatcggaaaagatgggctggcgggatatcctttaattagtgcttatctgactggaaaggagttaaagctggtagcagagattgatgcttcgatttcagattttatgacaactgcaagattgtattgcagtgggttgaattttacctttaatccgcaccggatgattttaaataaagtgacagattgttatctgaccggacaggatggaaaacgagaagaaattcaggatgataaactctatcatgtagtaacagacctttacacaggacagatgttaggttctgtgatggatatctcttatggtttattatcaatcattccgaaagacaaagagggaaatccaattgaggatttggaagaatacgcaattatggaagaaaatcaggaactaaaagcatgggttgcaattgcaaggtatatgcagtcctttgatgatacagacggcgatgggattgcaaatgtatctgagtattatgcaaccacacatggacgtaaagtagtagaaaatagcagaaaccttgttcaattgttgaaaaatccaaacaagttttttatgttaatgattggaatcgttactgtggcagttttgattgttctgttattgattttctttattcgaaaggtactccgtaaacggagataataatagccaagggtaacggagttttctatgatgaaactttatcctaaaaaaaaaggaatgagtaaaaatgaaaagaattgattttgaaaatggaactgtgacgggaaatattcttggtgccgctcttccaatgcttgtagcgcaaattttgagtcttttatataatattgtagatcgtgtgtatatcgcaagaattccagaggtgggaacggcagcacttggtgcagtagggttatgctttcctttggttgtaattattactgcatttgcaaatctgtttggaagcggtggtgctccgttgttttctatctacagaggaaagaagaaagagcaggaagcaggacgtatcatgaatacctcgttttcgatggtctgttgcagtgcggttgtcttaatgatgattggattactatttgcccggccgcttttgattttatttggagcctcagagagtgccttggtttatgcatatccgtatatgatgatttatctgattggaacactgccatctatggttgcagtaggaatgaatccttttatcaatgctcagggatattcaacaatcggaatgttttcggttgcaattggagcaattgcaaatttactacttgatccgttgtttatttttgtattgaattttggagtgcgtggtgcagcaattgcaacggtactttctcagggtctgtcagcagtatttgttttgttctttcttaccagaagatctgaattaagagttcattttcttaagaaagaagagatttctgaatgcatcggatatgcgaagaatattgtcagtctgggcacttctggatttatcatgcagcttacaaatagtctggtgagcatttgttgtaataatgtgctttctgtcacaggtggagatatttatatttctgttatgacgattgtttcgagtgtgcgtcagttagtagaaactccgatttatgcaatgaatgagggtgcttcccctattttaagttataactatggagcccgtcgtccggcacgtgtgcgaaaagcaggagttataatggcaagtatgattttgggatatacggttgttatgtggagtgtaattattttagcgcctcatgcgctaattcggattttcagttcagataaagtactaatgaaagatgctgtgattgcattaaaacagtattttgcagcatttatctttatggatctgcagtatattggacagacagtatttaagtcactcaataaaaagaaacaggcaatctttttctctctgcttcggaaggtatttattgttgttccactgacttatctgatgccttatgcattacatatgggaacaagaggtgtatttctggcagagccggtatcaaatgtgattggtggaagtttttgttttatcacaatgttaagtaccatattgccagaattaaaacgtatggagaattctgcaaaataaaaaactaaaaaaatgcttgcattttctgaaaattgtggtattatagttaatgcattgcgatgcgggtgtagttcagtggtagaacaccagccttccaagctggatatgtgggttcgattcccatcacccgcttttttgtatttatcattaattatggcttgtaaaatcagatttgattttacaggctattttttttataatgaaaaataaaaaaagaaagaagtaaaagacattgagagatttactggaacaattagagaggagaagtttagatgaatcaatttacgggatatgaattattatggttgtttctaatttattcttttttgggatgggtgctggagacagtcattgcaaccgtaagacagcgaaaggtggtaaatcgaggattaatcaatggtccattttgtattatttatggaattggcgcagtattgattaccatatggttacaggagctgagcgggttatggttgtttttattttcggcagtttatgcttctgtggtagaatggattgcagggcatctgattcagaaaatttatcatgagagatggtgggattattcagatattaagtggaatctggatggatatatctgccttccgttttcaatcatctggggtgctctgggatttgcaattgtaaagtggggaaaccgaatattaattgatttttttgcaatttgcccacaatttttaatgcatctcgttatctggatattgattggagtgttggcagttgatgcgctggcttcttatattttagtacgtggaacaagcaaagaactggataaatgggaagaggcaaataatcgttttgttcatgtaagtgtaaaatttgcaaaatggatagcaacgcatgtagaagatcgtattcataaggcatatccgaaagcagtaaaatcaaaagttttaactaaaaatgagacagtatttgcagcaggatgtggtttttataaaatagtgatgctgttttttatcggggcatttttaggagatatcacagagacgattttctgccgtatcacagcaggcgtatggatgagcagaagcagtgtggtgtggggaccttttagtattgtatgggggcttgcaattggtgcagttactgccttactttataaatataaagacaaaagtgacagttttttatttaccgcaggaactttgcttggcggagcctatgagtatttgtgtagtgtatttaccgaaatgatgtttggaaaagtattctgggattatagtaagattccatttaacctgggtggaagaattaacttattatattgctttttctggggaattgcggctgttgtatggtttaagaagttatttccgttttttgaaaaaggaattgaaaagataccgataaaaattgggaaaatggtgacctgggttttaattgtatttatgagttgtaatattgtaatgtcttgtctggcactgattcgatatgaccagagaagtaatcagatagaagcgaaaaatcaaatcgaggtctggctagatacgcattatgatgatgtgacaatgcagaggatttatccaaatgcaatagaagcaaaataaatgaatgcacgacaaacgcatgagtaaataaattgtgaacacacctcttttaaatagaaaaaaaaagaattggcaatggataatcattcatgcgtttattgtgaactctgtccccaatatcttgacaagtgggaacagatattataaaatcaacatattagacgaataggttatgaaggcggatgtaaggaaagatgcatccgcctctttatgatataaggagtgaagaaatgttaaatcaattttcaagaacagaattgctgttgggaaaagaggcaatggaacgtctggaaaattccagagttgcggtgtttggtgtcggaggtgttggcggttatgtctgtgaagcactggttagaagtggagtcggagcatttgacttgattgatgatgataaggtctgcctgaccaacttaaaccgacagattattgcgacaagaaaaacggtgggtaaatacaaggtagatgtgatgaaagagcgaatccttgagattaatccaaaggcggatgttcgaattcataagaccttttttctacctgaaaatgcagatgaatttccatttgaggaatatgattatgtggtagatgcagtggacaccgtgacagcgaaactggaacttgtcatgaaggcaaaagagaaaaatattccgattatcagcagtatgggtgcaggaaataaattagatgcgagtgcatttaaagtagcagatatttataagacaaaagtctgcccgcttgcaaaagtcatgagaagagaactgaaaaaaagaggtataaagaaattaaaagtcgtttattcagaagaacagccaatccgtccaattgaggatatgtcaatcagctgtagaaccaactgtatctgccctcccggagcaaaacataaatgtacggaacgacgtaatattccgggaagtacggcatttgttccatcggtagccggtctgattatagcaggtgaagtgattaaagatttgtgtaagaaaaacgaatgttttttatagacaggaactgtctctgtgaggggacaagggttgaaaaaatcactccattctgctatagtaaaaagacgaacacgtgatgaaccacgttactaaaaattactggagaagttttatgagtgaaaaaatacaagttctgggtatttcagttgagaaatgctatgtggacgaagtaatggacaatattaacgaaaactggaacagggatgatgttctggcaacttacggtgtgattaacatgaaaattcttcttgcagcgcagaaagatgaggaacttaaggaatacatcgacagtctggataagggagttgtggatgaaccggaagtattagaggctgcaaatatggatgacacgcgtatggaagaggaagtgcttgggcatagtttctttgcaaccttgttctggtatctctcccgttatcagaatcagatttatctgcttggagagacggaagaagaggccaatgcattttttaattacgtcaaggagaaatatcctgaaatcgtggttcttggaaagggcagtttaaaagatggcagtgaggatgactgcgataagattatcaatgatattaatgcatttgcaccacaggcggttttagggtgttccggagatttcagtatcgagcgttttgtaaaaaaacatcgaaaaaaaatgaatacaagagtttttttctgtcttggagaacgtgcagaaatccagaaagaaaccggtgtaaaaaaacgctggttggaaaaaatactggagaaaaattcttttaaaaaattagtctcccagttcaatgaggatgagaaaaattaagagacatcactgcaaaaatgataaagagaaaatatgaacaaaatgttacattttgaaaaaaatatgtaatattttgcattttccctttattttttttctgttatgtattactatataaagtgaggtttttgttttttggggaaagaacaatgcgtgtcagaacagccaaaaaaagaaagttaaagctgtatggcgtagaataaactatatgatgaaagagggtatatacatgatttcaaaccaggtattacagaacacgttagatggacttcgttccataaccagaacagatttgtgcattactgatacagaagggaaagtgctcgcatcgaccttttctgaaactgtatgtacagaggatgaagtgttggcttttgcacagtcacaagcagacagtcaggtaattaaaggatatcagtattttaaagtgcatgatgaccatcagttagaatatatactggtgattaacagtgcaggagaggatgtctacacacttggaaaactggttgtttttcagattcagagtcttctgactgcatataaagagcgttttaacaaagataactttattaaaaacctgttgttagataatctgcttttggttgatattcataacagagcaaagaaattacacatcgaagttgaccagcgcagggttgtgtttattctggaaactaatcaggataaagattatggttctttagagaatgtaaaaaatgttctcggaggaaagaatggcgattttgtcacagcagtcgatgagaaaagtattattattgtaaaagaactttcagaaagcgacaattacccacaggtggataaaattgcaaatacaattctgacaacccttggagttgaaaaagacagcaatacccacattgcttatggtacgattgtaaaagaattaaaagaagtatcacgttcctacaaagaagcacgtatggcactggatgttggaaagattttctttggtgaaaaagaagtaattgcctacagttcacttggtattggacgtctgatttatcagcttccgattccgctttgtaaaatgttcattcgggaaatattcgacagcaaatcaccggatgattttgatgaagaaactttgactacaatcaacaaattttttgagaacagcctgaatgtttcagagacctccagacagttgtatatacacagaaataccctggtttaccgtctggataaactgcaaaagagtacaggtctggatttgcgggtgtttgaagatgcaattacatttaagattgcgttgatggtagtaaaatacatgaagtatatggaaacacttgattactgatatcttaaagaggggtcagatatcaggaaaacaggaggatttttatgattgatttaaatggcgtgagtaaatcatacagcaagggtcagccggcacttgacaatgtgagtctgcacgtagatgagggtgaatttgtttttatcgtaggaaacagcggttcaggtaaatctaccctgattaagcttctgttgaaagaacttgatccgacagccggaacaattacagtaaatggctatgcattaaataagttaagacgcggaaaggtcgcaaaataccgcaggggaattggagttgtattccaggatttccgtctgctcaaagacagaaatgtctatgaaaacgtggcatttgcacagagggtaattgaaaaaccgacacgtgtgattaaaaaacgagtgccggaagtattgactttggtaggtcttgcagaaaaatataaatctcgtccggatcagctctccggtggagaacaacagagggtggcacttgcaagagcacttgtaaaccgtccaaacattctgcttgccgatgagccgaccggaaaccttgacccgaagaactcttttgaaattatgaaactgcttgaggaaattaatgagcgcggaacgaccgttcttgtagttacccataacagagaaatcgtaaatgcatttaagaaacgtgtaattacgatgaagaaaggcgtcatcatcagcgacgaacaagaaggtggatatcagtatgagagttagtacgatgacatacatattgaaacagggatttaaaaatatctggagaaatatccgattttctttagcatcaatcgcaacaatggcagcctgtattttcctgtttggaattttcctctctctggttatgaacttccgttacatggttcattccgcagaagaaggagtagcagttgtcgtttattttgatgagggtgtgaaacaggaacagattgatgatatcggttctaaaatcaaaaaaatgtcggaagtagaacgtgcagagtatgtatctgcagaccaggcatgggaagcatttcgggatgaataccttggtggtgatgacacacttgcagaaggattccgtgaccaggataatcctctggcaaattcagcgagttatcaggtttatttaaaaaatgtagaatcacaggataaagtagtaaaaaaaattgaaaagatggatggcgtgcgtcaggtaagccagtcacagtcggctgcaaaaaccctgtctacattcaataaactgattggatatgtatcattagcaattatttttattttacttgcggttgcattttttcttatcagcaatactatcacaatgggtatttctgtacgacaggaagagattggaattatgaagctgattggtgcaacggatttctttgtaagagttccatttgtaattgaaggaattattctgggaattatcggtgcagtaattccgatggcagtgctgtatggactttataatcaggttattaactatgtaatgacaaaattccatcttctcacaggcttccttcagttccttgacgtatggcatgtattcagaattttacttccggtcgggttaggtcttggaattggaatcggattctttggaagtattctttctgtaagaaaacatttaagagtataataaaagtgtcaacagagatatttaggcaaattagaaggaggtatagccaggaaaattctggctgtatctccttgttttgtgaaaggagacagaaaagttggaaaaaaacaaagtaaaggggtttgtgaccggtgtattgtgtaccgtactggtaggcggtgggatatttggaggatgctatgtcttgtcgaataaagaccatgcggtaaatcaggaatcggttcagaaagcaaaagcaatcgaaaacctgattgataaatattatctggataaaattgacaatgatgaactggaatcttatctctataaggggttgatggctggacttggcgacccgtattctacttattatacagcagaagagtataaagaactgacagaagacaccgaaggggtttatcgtggaatcggtgtgacgatgcaaaaagatgtgtctaccggagcagtgaccgtcgtaaaatgttttgagggagcaccgggagcagaagcaggattacagccgcaggatcagttagtcaaggtcaatggcgaggatatcacagacaaagaactcagtgaagtcgtaaaaatgataaaaacttcggaatcagataccgtgacactgactattttaagagaaggcgaaagcgattaccgcgaagtagaagtaacgcttgataccgtagaagcaccaatggtagaacatgaaatgctggataataagatcggttatattacgattaaccagtttgcagaaactacggcgagccagtatgaaacagctttagaagatttaaataatcaggggatggagcgtctgattgtagatgtcagagataatccgggcggacttttaacttctgtatgtgatgtcttggattcgatgcttccggaagaactgcttgtttataccgaagacaaaaatggcaagaaaagtgaatataatgcaacaggcactgaccagtttgacaagccgatggtaatactcgtaaatggaaacagtgcaagtgcagcagaaattttttccggtgcgcttcaggattacaaagtggcaaaactggtaggaacgaccacattcggaaaaggaattgttcagcaaatctttaatctttctgatggaagtgcagtaaaaatgactatttccaagtattatactccgagcggaagatgcatccatggaacaggtttagagccggatattgaggtggatttgccggatgagttaaaaaatcaggttagtattgataagagtgaggacactcagcttcaaaaagcgattgagactgtaaaagaaatgcagtaaaataaaaaaataaaaaagttaggagaaacagcctatgtataattttgtaattctgacagataataccgtagatatgccagttgaatggttaaatgaacatgaggtaggttatgaatgtcttccgtgcagtatgaacggagtagtttatgataaaaagaatccgattgatacaaagctgttttacaggcagatgagagaaggagcaatgccgacaacttcccagatgaatccggcaatggcagaggcaatgtttgagacttatttacaggagggaaaagacattttatatcttgccttttcttccggtttgtcggggacatgcaacagtgcccgcatagcagcagaggaattaaaagaaaaatatccggaaagacaaatcaagataatggattcattagctgcatccatgggggaagggttactgctctattatgcagtaaaattaagagacaagggaaagaacctggatgaaatctgtgactggctgttggaaaacagactgcatctgtgccatgtatttacagtagatgatttaaatcatttacacagaggcggaagagtttccaaggcaactgcagttttaggaacactggcaaatattaaaccgatgcttcacgtagataatgaaggaaaactgatttcaattggaaaggtcagaggaagaaagaaatctcttgcaacgttagtttctatgatggaagaacgaattggaaaatattgtgataaaaatgaagccgtgtttatcagtcatggagattgtgaggctgatgccgagtatgtggcaggactggtaaaagaaaaatttggaattgaaaatattatgattcatccgattagtgcaacgataggagcacattctggtccggggacagtagcgctgtttttccttggagaataccgctaaagaaaaaatcagagctaaaaaagcgataggaagtaattttggaggaagcaaatgaatttaaactttaaaccggtagaagcagaagatttggaaaaactaaatccgtttttctgtaaacgaccgaataaaacctgtgacagtgtgtttttagacagctttatctggagagagtattataatgtaagatatgccgtcagcgataataaggcaattttatggctgatggatttagatggaaaaacaggttctgcaatgccgatttgtagtgaagaagatttagaatattatttttggaaattggtggaatattttaatacagaattaaaggcaccactgtatattaatctggcagatgaagaagccgtagaacagttaggtttaaaaaatatgccggataaatttaagattacagaacaggtggatttaaaagactatctgtatgatggaaatgcaatgcgtaccttgtctggaaaaaaactgcataaaaagaaaaatcatttaaatgcttttaaacgagaatatgagggcagatatgagtaccgccgtttgtgctgttcggacagaggtgatgtctggaagtttttggatcgctggagagaagaaaagggcgaagaggtagaagagcatctggattatgaagtgcgtggaatccatgagattttaaagaattgttcgcttctgaatgtcagaatgagcggagtttatattgatggtcatttagaagcctttacgattggaagctacaatccgttggaacagatggcggtgattcatattgaaaaggcaaatccggaaatcagaggattgtatcagtttattaatcagcagtttttgattgaagagtttccggaggctgttttaattaaccgtgaggacgatttaggcttagagggattaagaaaagcaaaactttcttataatccaattgactatgcaagaaaatatcaggtagaacagatttggtaaatcggagcgttgatttgatatgaagaacagatatttaagcaacgaggaaaaaagagcctgcgaagggctctggagtgaagcatttttcgaggacagtgattcctttcgggaatattattttacagagaaagtaaagacaaatcagatactcgtggcagaaaaagacggacaaattttgtctatgattcatcgaaatccctatcagttgaatattaaaaatcaaaaagtaatctgtgattatctggtcggtgttgcgacgaaaatagaaaacagaggtcagggatatatgcgaagtctcttaaaacaggcatttttggatatgtatcaggaggatatgccgttttgctttctgatgccggcagatcgtcgtatttatgagccgtttgattttgtgtatgtatttgaccagccggtgtgggaattaaaatcaaaagactggctggaacaggacgtgacagaagagtcggcaaaggaaatcgcagactggatgaatgagtggttaaatgcacggtatgatgtgtttacatggcgggatgaggattatgtgaaagttctgctgaaagaattaaaaagcgaaaatggaagtttagaagcattaaaagcaccggaaaatccacatcagataaaggcattaagggcagagtggggaatggagaaaaaagaacagcgtctgctttatgccaatgctgatgactgcaaaaagataaaacaagaacctgcaattatggtaagaatcgtgaaccttccagagtttttgaaatatatttgcctgaaagataatgtagcagagcaggaagtgctttatcagttaaaggtaagagataaactgcttgaaaagaatgatagaatctggatttggcatgtcaatcacaaggagtcttttgttgaagtattcgatggaaaagttttttggaagaaagagtcagatgagcaacaggagaaaaatttacaaaaagaacgaaccatagaacttgaaatttcagaactgacatcgtggttattgggatataaaataccagaaaacataagtgagactgtaaaagcagaaatctgttgtatcaataggattttcttagatgagattgtttagtaaagctgtttcattcatgcagcacaagagaaaagagggaaaacgagcatgcaaacagaagaaatgctggaagaactgttaaaaaaggcaaaggtggatatgtcacttcggcagaaattatttgatacaagaaatgagaaaaatccagtttccgcattttgtaaaacttgcagagaattggggtacgaaatctatgatatggatttaatcagcgccggagaagaattttacgcaaccatgagaagaagtacaaatggtggaggagaaaattctccaatgctggagggtgaagatgatttctatgaactgttttttgcaagtctggaaagtttataaggaatcgttctgctcccatgcagttctaataaaggttagaaataccttggaaaagataaagaggaaaaagaaatggaaatagaaatacaaaatattattaaaattgtggaagatgcagcaggaattttatcacaaagagatttgattggagatatctctgtgaaaggtccggctgatttcgtaactgaggcagatagggatattcagcagtttattcaggcggaacttctggttcagtatccggacattcagtttcttggagaagaagacagccagaaagaggtagatttctacggaaaaatgtgggtgcttgacccggttgacggaacgacaaatctgattcatgattatcgttccagtgcaatttctctggcgttgtttgaggcaggaaaaccggttcttggaattatttatcagccatatacaaaggaattattctgggcgcagaaaggaaaaggggcatttcttggcacagaaagaatttctgtcagtgaggctggttctctttctgagagtattgtaaatgttggaacatctccatataaaaaagaactggcagacgaaaattttgagctgattaaaaaggtattctgtaaaagtcaggacatcagacgaagtggttcggctgccttagaccttgcatggattgcctgcggacgcagcgatgcattttttgagcgcaatctgaaattatgggattttgcagcaggctggataatcattgaagaagcaggcggaaaaatagcagattttaatggtatggaaataagcccggtgattgctgcggatattgttaccggaacaccaaaagtctgtgaggagcttttgacacttatcaaagaaaattgaacgcagataagcattccaccgcttcaagtatgcggagcactaagcggcgggtgagggggatgcttctgtcagtgggagtgaaagctcccgctgacagatcgcaaagcgactgcgttcatgagcaagtagcgaagtggattgcgaatgtccgctttacattaaaaagaagcacggaatttagagggagagactccatactgctttttgaaggctttgcttaagtgaaattcatcataaaatccgaagttcagtgcagcctcgtgaagttttgcgtctggttgatgaatcagaaaatcgcgtaccatttcaagctttgtctccatttgataagcataaaaggtttttccgtaatttttaaaaaaatggttatttaaggtacgggcacagatataatagctgtctgcaatttcggaagcggtataaaaaacctgaggattggattgaagtttctgcgtaacctcttccaaaagggaatcggttttatgattggagcagatgttatcatttaattcatgaatttcgcagagcataagattaaataataaagaaattcgatgttctttctgggggcttttcgaccagtaggcacgaataatattttgaaaataagtgcggattagaatccgttctttacagtgcaataaggtatggcatggaaaagtagaagaggattccattttttccatgctgttttttgtggatgaaaaactctgccttttagaattaagaacgtgtttgctgtcagattccaaagcggtaggaaggacgtgcaggtacatgtgacgattgccggcattgcagggaatccgtccatagtgatggcgtccggcagatagaattaacaaatcatcttttgataaatgataagccttgtcttcttcaaagatttcccattctccatctaaaatatataaaaaatcgtgcacatccataatccggtttgggtgaaccattccgtttacggaagtgatataatttgcaccggttatccggcggtcagccatttcttctaaattcagcataaaaaaatcctcctctgaaacagaattaatacagaatgattaaaatctgaaaattcatatctttccaaattatacatgtaaatttccgaattggcaatggattccacaggctcaaaatgctagaataaatataacgatatgagtgtcaaaagtacatcaaaatgatttgggaggaaatttacatggacaagacaaaattcagcagaccactttctttaaaaaacgtacagattacggatacattctggaaaaaagagatggaattagtaaggacagaagtaattccgtatcagtggagagctttaaatgatgaggtagagggtgcggcaccaagtttttgtatgcataattttgaagcagcaggcagacagaacgaggaaagaagagagaaaggagcagaatttaaagagccggtttatacatttcgtggatttgagacgcttccggaagaccctgagcatctcgaagacaagttttacggatttgtatttcaagacagtgatttttataaatggattgaagcagttggatattctttaagccagcatccggatgaaagattagaggcgattgcagatggtgcgattgatattgtctgcaaagcacagcaggaaaatggctatctggacacttattatatcttaaatggaaaagataagatttttacaaatttaaaagacaatcatgaattatattgtctaggacatctcttagagggagcagttgcctactatgatgcaactggaaaagacaaattattaaacgcagcaaagcgttatgcagattatgtagattcctgctttggaaaagaagaaggaaaatgtaaaggttatccgggacatgaaattgcagagatggcactggttcgtctttatgagacaactggcgaagataaatacttgaatctggcacgtttctttattgatgagagaggaacaagaccatattattacgacaatgaacatccggaagaagtgaaaaagaaaccagacggattgcgctatgaatataatcaggcacacaagccggttcgtgaacaggacgaagcagtcggacattccgtacgtgcagtttatctttacagtggaatggcagatgtggcaagactgacagaagatgaaagtctgttaaaagcgtgtgaagtgctctggaacaatatgacaagaaagaaaatgtatattaccggaggaatcggtgcaacccatattggagaagcattttcctttaattatgatttgccgaatgatactgcttatgcagaaacctgtgcatccattggactggtatttatggcaagaaggatgttagagatgacgccggatgcaaaatatgctgacgtaatggagcgtgcattatataatggagttttaagtggaatggcattagatggaaagagcttcttctatgtgaatccattagaggtgcttccggaagcctgccacaaagatgagagaaagttccatgtaaaaccggttcgtcagaaatggtttggatgtgcctgctgtcctccaaacattgcaagattattaagttctatcagtacttatgcatacaccgaaaataaagataccttatttgtacatctgtacattggtggagtaattaaaaaacagctggatggacaagagatcgaaatcaaagtgacatctgaatttccatgggatggaacagtaaaagtaaaaatgcctgcaaccgaaaaaccatttactctggcatttagaattccacggtgggcaaaaaattatcaggtaaaaggcatcgatggtgccaaaacagaagaaaaagccggctatctctatgtgacaaaacagtggactggaactgaaacagtagaattggaattcccaatggaagtaagactggttcagacgaatccaaaggtaagggaaaatattggaaaaatcgcagttgtaaggggaccgattgtgtattgtctggaagaagcagataacggtgcagatttacatttagtacgtttaagtccaaaggcagtttgtgaagtaaaggctgagaaaatcgcaggagaaccggtaaaaacagtgctgacagagggattacgccagaaaaattcagaaaatccagaagaggaagaactgtacaccatcgcagaaccagataccgaagttccggctgatttgaaatttattccatattatgtatgggcaaacagaggcgaaaatgaaatgatggtatgggtgaaaaaagcgtaaatccagcagaaactgtagttgccaaagaaaataaaaaagcatataatagacctgtaattgataaaatgagacatcaaagaacagatggagaaagagaggtcttaaatgtattgcacaagaaaagtagcagatgatttaatctgggtaggagcagatgacagaagacttgccatgtttgagggcgtgtattctgtgccaagaggagtttcctataattcatatttattattagatgaaaagaccgttgtatttgataccgttgaccatgcagtagagaaaacatttctcgaaaatgtagaacatggattaaacggaagaactttagattatcttgtagtacagcacatggaaccggaccattccgcaacaatccgtactctgttgatgctatatccggaagcagaagtggtatgcagtaagaaaacagaaggaatgttacgtcagttttttggcgatgcagttaagatgaacataaaagtagtcggagaaggggataccttaaaaaccggaaaacatgagtttaccttccttgctgcaccgatggttcactggccggaagtcattgttacgtatgatttgacaaccaaaactttgttttcagccgatgcttttggaacatttggcgcattaaatggcgcattatttgcagatgaagtggatttcttccgtgattatctggatgaagcacgcagatattataccaatattgtaggaaaatacggtgttcaggtacaggctttattaaagaaagctgcaactgtggaaattcagaccatttgcccgcttcatggatttgtatggagagaaaatatcggcgcttatctggaaaaatatcagaaatggagcttatatgaaccggaagtaagcggtgttatgattgcgtatgcgtctgtatatggaaatacagaaaatgcagccaatattcttgcatgcaaattacgcgataaagggattaagacaaccatgtttgacgtctctgtagctgaaacttcagaagtagtcgctgcgtcctttcagtacagtcatctggtatttgccgctccaacttacaatggcggaatctttattaagatggatgaagtactccgtgatatcgaggcacacagcttaaagaaccgtaccgtagcatttatggaaaacggaacctgggcagtgacctgtggaaagcagatgaaagaaatttttgcaggattaaaaggcatgaatattatagaggatactgttacaattaaatccgcactcgcagacggtcaggaagcacaggtagaaaaactggcagaagcgattgccgaaaccatgtaaaaaaaacaaaatcaaaaataaaaaagaaccaatggttaatgacggttgaccattggttctttttaagtttatctttattattaaaattagttcagagtattaacagctttagataaacgtgaaacttttcttgctgcgttgtttttgtggtaaacaccttttgtagcagctttatcaattgtagaaatagcgtttgctaatgctgcaactgctgcttctttatcttttgctacaactgctgcttctactttcttgatagaagtcttaactgctgatttgatagatttatttctgtcagcttttttctggtttactaaaactctttttttagcagatttaatattagccaaatccgtacacctccaaaattattatatttcgtattcgtatgtttattatctgataccaaagaagacacgggcactttggtattcacatgcttttttattctagtttatttattgcaaaatgtcaatacataaaatctatgaaaatgcaaaaaatagaaataaatctgatgaagagggagaaaaacagcatgattcgaggaagaatacacaccgatttggcactggaagcaaaagaaagatatgaggaggataatgtagaaatcaggggcgtctgtattgaagaagagtataacgaggaaaaagatatccgtacgactttggtaaaaattgaaaccgaaaatggagcacgggcgatggggcgtccgcagggaagttatctgactttggaagcaccgaatctatctataccggatgagggttatcacagagaaatttcggaagaactggcaagacaggttaagaaactgataccggagaaaaaagaattgacggttttggtggtgggacttggaaatcggcaggtcacacccgatgcgctgggaccggatgtggtggacaatttaaagatgacccgccatataattttagaatatggtgcacaggcaatgggagaacaaaatatgtatcaagtcagcgggctcgttccgggggtgatggcgcagactggaatggagacacttgaaattgtaaaaggtgtgataaatgagaccagaccagatgttgtgattgtggttgatgcacttgcggcaagaagtacaaagcggttaaatcgtacaatccagattacagataccggaatcattccgggctctggtgtaggaaatcacagaaatgggctgacaaaggagacacttggagtaaaggtaatcggaatcggagtgccgacggtggtggatgcagcaacaattgtacaggattcaatggaaaaactgcttcagacattagaagaaaaagaaaagaaagaatttctggaggaaatgattccaccggcgttatacagcatgtttgtgacgccaaaggacgtggatgagacaatgaaacggttgtcttatacaatttcagagggtttgaaccgagtattttgttaaaaagcaggttcagaacttatctgtgttcatgagcaagtagcgaagcggattgcgaatgtccgctttacaaggcataaagcgcagggattgtctcatataaagataggaggtgatagggggaacaaaatgagagaaggaaacaggacaaagctggttttatggggaatttttatcgttcttgcaggatatctgagtttgaaggggctctcttttgataaagagacatttgtatggatgggaataaatctggaagagcaggcagtcgaggtttatctcccatcgatattagaatcggatggaaaagacgcatcgcttagtgccaatattttaagtgggttatttgtaagaggtgggataaatgtacgaagcatttcggaacaggcgggggcagattcggaaaccgaccggaagattatcaaagaaaatgaacaatttttagttgaaaatctgacaaaggaaaatcaggaggcgggaccgaaagaaaaaaatcaggagagtacaggaatggatagtgaggaaaaaagtgcagtggaagaaaacatgcaagaaaatacggaagaaagtacgcaagaaaatacagaagaaaagattgaagaaaatgcaggaacggaaaacgggcagaaggggacattgacagccggtgccccggtcatggaccttccattggagcagtttcaggattttaattttgtcatcagcaatttttatacgatagataagacaaccagcattaacagtgaacagcttaatgcagtgacactcttggaaaaagatttgcggatgagtgcaggggcagaaaatccgcagattctgatttatcacagtcattcacaggaggaatttgcagattctgttccaggggatgcttccacaatgatagtgggggtgggagagtatttgacgactctgcttcgggatacatacggatacaacgtcatgcatgtgacagacacatttgatattatgggtggaaaattagacagaaataaggcttataactatgcacaggagaccatcagccggattttggaggaaaatccaagtattgaagtggtgattgacctgcacagggatggagtaaccggtgcgaaacggctggtgacggaaataaacggaaagccgacggcaaagattatgttttttaatggtctaagccggacgaatcaaaatggagaactttcccatctgccgaatccttatattcaggataatcttgcattttcgcttcagcttgcgcggtatgccaaagaatattatccggactggtttcgtacgatttatctaagaggatatcgctataatctgcacttgagaccaaaagctttgctggttgaatgtggggcacagacaaatacggtagaagaagaaatgaacgcaatgcagccccttgcagacattttgaacaaagtgctgacaggggcatgaaacgcttgcgcatgcagggaatctcgtgctatactgagcgttagcaagagataaaaatcactttaaaattaaaataaagttcaagttgaaaaacagtttagaggagaaaaaacgaatttatggcaggaattgaacaaagtaaaatcagaaatttttgtattatcgcacatattgaccatggaaaatccacccttgcagaccgtatcattgaaaaaaccggtcttttaactgcaagagagatgcaggcacaggtgcttgataacatggagttggagcgtgagagaggaattacaatcaaatctcaggcagttcgtattgtatataaagcaaaggacggagaagagtatatttttaacttgattgataccccggggcatgttgactttaactatgaggtttcaagaagtctggcagcctgtgacggtgcaattttagttgttgatgcggcacaggggattgaagcgcagacacttgcaaatgtatatcttgcactggaccacgatttggatgtatttccggtcatcaataaaattgacctaccaagtgcagaaccggaacgtgtcaaaaatgaaattgaagatgtcattggaatcgaagcacaagatgcacctttgatttctgcaaaaatgggactcaatatcgaagaagtgttagagcagattgtgacgaaaattccggcaccgacaggggatgcgtctgcaccgcttcaggcattgatttttgactccgtctatgattcttataagggtgttattgtattttgccgaatcaaagagggaacagtaaagaaaggtacacgtattcgtatgatggcaaccggagccgtagaagaggtagtagaagttggatattttggagcaggacagtttattccatgcgatgagttatccgcaggtatggttggttatgtcacagcaagtattaaaaatgtaaaagatacccgcgtgggtgatactatcacagatgatgagcgtccatgcgatgcaccgcttccgggttacaaaaaagtaaatccgatggtatactgtggtgtctatcctgcagatggttcaaaatatcaggatttaagagatgcacttgaaaaactgcagttaaatgatgcctcccttcagtttgaaccggaaacttcaattgcattaggatttggtttccgctgtggattcttagggcttttacatcttgaaattattcaggaacgtctggagagagagtacaatcttgatttggttacgactgcaccgggtgttgtttaccgtgtctataaaacaaatggagaaatgatggaattaacgaatccgtccaatcttccggatccatctgaaattgattacatggaagagccgatggtaaaagcggaaattatggtgacaacggactttattggaccgattatggatttatgtcaggaacgtcgtggtcagtatcagggaatggaatatatggagactacacgtgcacttttaaaatatcatcttccactgaacgaaattatttatgatttctttgatgccttaaaatcccgttccagaggatatgcttcttttgattatgaaatgcttggctatgagagaagtgagctggttaagctggatattttagtcaacaaagaagaagtggatgcgctttcttttattgtatttgaaggttctgcttatgagcgcggcagaaagatgtgtgagaaattaaaagaagagattccgagacagctctttgaaattccgattcaggcagcaattggaagtaagattattgcacgtgaaaccgtaagagcaatgcgaaaagatgtacttgcaaaatgctatggtggagatatttccagaaagagaaaactgcttgaaaagcagaaagaaggaaagaagagaatgcgccaggttggtaacgtagagattccacagaaagcatttatgagtgtattaaaattagacgaagattaagctattgtgacagtaataaagaaaagtaataaaaatagatcaaaataggtcagtgtgtgggaaggtagtaaaacaaatgaagaaggatttggggctgtatcttcatgtgccgttttgtgtaaaaaaatgcgattactgtgattttttatcaaaagaggcagcagaagaagaaaaagaggcgtacgtagatgcgctgataaaagaaataaaaagctataagaaatttgcggggaattacaaagtatcaacagtttttgtgggtgggggaactccgtcctgcttaagagcggaacagacaaaacgtatctttgatgcactttatgaaatctttgaatttgtcaaacatccggagattacaacagagatgaatccggggacggttgacagagaaaaacttgaagtttataaggcatgtggaatcaatcgtttaagcatcggcatgcagtcggtaaaagatgagaatttgaaagtgcttggacggattcacaattttgaacagcttctggaagcttatcagttgtcaagagaagccggatttacaaatattaatctggatttgatgtcctctttgccttctcagaccaaagaggaatgggaagaagaactgcaaaaaacagtggaattaaatccggaacacatttctgcgtatcagcttatcatagaagagggcacacctttttatgaaaaatatgatgcacatccggaacttctgccgaatgaagaggaaagcagagcaatttatcagacaacaaaacgtatcttagaagcaaacggctatatgcagtatgagatttccaactatgcgaaaccgcagaaagaatgtaaacataatctgcgttactgggagcggggagagtatcttggaatcgggcttggatcagcctctctgattcaaaatatgcgtatgaacaataccagagagatgagtgaatacctggaaaaatccgcagtgccaaaagagatgcgaaaagatgtggaatttttagagaaccgtcagcagattgaagagtttatgtttctgggacttcgcaaaacttatggtgtttcgaaaaaagaatttcaccgtgcctttggacgggaactcgaagatgtgtatggacagaccttaaagaaatttattgaagagggcatgataaaagagaaaaaagaccgaatctttttaacggaagacggggtactggtaagcaatcagattttatcagagtttctgttttaactgcctgatttttgttcgggctatcttaagaaatattagaaaaatttaagaaagttttagaaataaaatctggaaaaataaggacttctgtggcaaaataaaagacgcaggagttgacaggtatgttttgtaatggggacagagctacataaataaactccgaaagatggtaagagcgcatataagtttatgggaggctttatattatgaatattttatttttccttactccaaaaagtgatgttgcttatatttatgacaattacagtttaagacaggtgcttgaaaagatggaatatcacaagtattcctgtattccagtgattggagtggacggaaaatatgtaggtacaatcacagaaggtgatttgttatggggtctgaaagaacgtggggcatttgatttgaagaaagcagaagaagttccgattcgttcctttgagcgtagaatggattatgcaccggttcggattgattcggatatggaagatttgctcgataaagcacttcgccagaattttgttccggttatagatgaccagaagaattttatcggaattgtcacaagacgtgatattatgatgtatatggcatctgccgacagaaaatcaaagaccgaatcgaaaaaagtatatatggaaacagtaggttaaccacttaagtcaggataaaaattataagaaaaggacagtctaatacaggctgtttttttcttttacaaagttataaggagagtgttaaaagtataaaaacgtgtcttgaaaatgatacgaacaaatgtttgtaaataaaaaatccctgtgctataatgatactgttgaagttaatcagatcgcaagaaggaaatgaggaaaaatacattgagaaatcaggaacataaatttattaagatacgtggagcaaatgaaaataatttaaaaaatttaagtgtagacattccaagaaatgaatttgttgtgctgaccggtttaagtggttcaggaaagagttctctggcgtttgatacgatttatgcggaaggacagcgcagatatatggagtcgctttcttcttatgcaagacagtttttaggacagatggaaaagccggatgtggagagtattgaaggactgtctccggcgatttccattgatcaaaagtcaacgaatcgaaatccccgttctaccgttggaacagtaaccgaaatttacgattattttcgtttattgtatgcaagggtggggattccgcattgtccaaagtgtaaaaaagaaatcaaaaaacagaccgtagaccagatggtagaccagattatggcactgcccgagcggacgaaattccaactgcttgctccagtcgtaagaggccggaagggaacacatgccaaactgctggaacaggcaagaaagagcggttatgtccgtgtgctgattgacgggaatctttatgaattaaatgaagaaatcaaattagataaaaatattaagcataatattgagattgttgtagaccgtctgattgtaaaagagggaatcgaaaagcgtctgaccgattctattgaaaatgtgcttcatcttgcagatggactgatggtggtagataccatggatggaaacgtaattaatttcagtcagagcttttcctgtccggattgtggaatcagcattgatgaaattgaaccgagaagcttttcgtttaataatccgtttggagcgtgtccggactgtttaggtcttggatataagatggaatttgacgtggatttaatgattccggatcagagtttaagcattgccgagggtgcaatcgttgtgcttggatggcagtcctgtacggataagggcagttttacccgtgcaattttagatgcacttgctgaggaatatcattttgatttggaaactccgtttcaggattattcggatgaaattaaagacgtgattctcaatggaacaggtggaaagaaagtgaaagtttattataaaggtcagcgtggagaaggcatttatgatgttgcttttgaggggcttatcaaaaacgtggagcgtcggtatagagaaaccggttcagagagttccaaacaggaatatgaaagtttcatgcagattacaccgtgcaagacctgtaaaggtcagcgcctgaaaaaagaagcgcttgccgtaacagtcggagagaaaaatatttccgaggtaacggcacttttgattcgtaatcttcaggaatttttggaaaatttaaagcttacagagacacagcagttagtcggaaatcaggtgttaaaagaaattcgtgcaagggttggttttcttgtgagtgtaggtttagaatatctgacgctttcaagagcgaccggaacactttccggaggagaggcacagagaattcgtctggcaacccagattggttcggggcttgtcggggttgcctatatcctggatgaaccgagtattggactgcaccagagagataatgacaggctgttatccgctttgaagcatttgagagatttaggaaatacgctgattgtggtcgaacatgatgaagatacgatgagggaagccgactgcattgttgatattggacctggtgcaggagaacatggaggagagctggttgcaattggaactgcagaagaaattatgcagtgtccggaatcaattactggaaaatatttgagtggtgaattaaagattccggttccaaaggagagaaaacagccgacgggatttttgactgtaagaggcgcagaggaaaataatttaaaaaatatagatgtcaatttcccattgggggttatgacctgtgtaaccggagtatcaggttctggaaagagttcgcttgtcaacgaaattttgtataagagtcttgcaaaaaaattaaatcgtgcaagagtagtggcaggaaaacataaatgcatcgaaggagtggaacaacttgataaggtcattgcgattgaccagtccccaatcggacgaactccaaggtcaaatcctgcaacgtatacaggagtatttgaccagattcgtgatttatttgcggcaactgcggatgcaaaagcgagaggttataagaaaggtcgtttcagctttaatgtaaaagggggacgctgtgaggcatgtagtggagatggaatcttaaaaattgagatgcattttcttccggacgtttatgtgccttgcgaagtgtgtcatgggaaacgttacaaccgtgagactttggaagtcaaatacaagggaaaaagcatttatgatgtgttaaatatgacggtggaagaagcactggaattttttgaacatgtaccgtctatcaaaagaaagattcagaccctttatgatgtaggactttcttatatccgcttaggacagccttctacggagctttccggaggtgaagcacagagaatcaagctggcttctgagttaagcaaaagaagtaccggaaagacgatttatatcttagatgagccgacaaccggacttcattttgcagacgtgcataaattaatcgaaattttacagcgtctttgtgaaggaggaaataccgttgttgtcattgaacataatttagatgtcataaaaactgcggattatcttatcgatattggtccggaaggaggggataacgggggaactgtggtggcatttggaacaccggaagaagttgcagcgaatcctgtctcctatacaggtcagtacgtgtcaaaatatttgaaatgattgcctcttttcatttttcggtaagttcggtataatgaaacacacagcagtcaggctgtggtctgccagaatcttaaaataagatgaaaataaaaggcaggaaaggggtaaaaatatgggagctacagagattggaattgacttgggcacagcgaacattctggtatatgtaaaaggaaaaggaatcatattaaaagagccatccgttgttgcttatgataaagatacaaataaaatacgtgcagtcggcgaagaggcaagacagatgattggaagaacaccggggaacattatggcgatacgtccgatgcgtcagggtgtgatttcagactatgaagtaacagaaaagatgctcaaatactttatttcaaaggcaatgggaaaaagagcgtttcgaaaaccaagagtcagcatttgtgtgccaagcagtgtcacagaagtagaaaaaaaagcagtagaagaggcaacttatcgtgccggtgcaagagacgttgcaatcatcgaagaaccgattgcagcggcgattggagctggaattgatattacaattccatttggaaatatgattgtagatatcggaggaggaacaacagacgttgcagtaatttcgctgggcggaacggtagtttcaacttccataaaagtagcaggagataactttgatgaggcaattatgcgttatgttcgcaaaaactataatttgattattggtgagcgtacagcagaggcagcaaagataaagataggaacggtttatccggaaactcttccacatacaatagaagtaaagggcagagatactgtatccggacttccaaaaagtgcagagatttcatccgaagaaatccgtgaggcacttgcagaatgtatcgctcagattatggaagtgattcacagtgtccttgagaaaacaccgccggaactggctgcggatgttgctgaacgtggaattgtcttaactggaggcggggcgcttttgggtggattcgaaaaattgattgaagaagaaacaggaattaatacagttgttgcagaagaccctggaatggtagtggctgttggaacaggacagtaccttgatgtaatgagtaaagtcgagggaaaataagaaaggaaagcagatggaggaaaccatagaaggatacgttgaccacattatctttcgaaatcaggataatggatatacggttatggtggtagtcacagaggacgaagaattaacttgtgtcggcagttttcagtatatgaacgagggagaaacgataaaagcgttcgggcattataccgaacatccctcctatggacggcagtttgtaatgagttcttatgaagtcattgttccacaggattctcaggcgatggagcggtatttggcttcgggagcagttaagggaattggagcggcactggcagcaagaattgtccgcagatttaaagaagacaccctgcgtattatggaggaagaaccggaacgccttgccgaggtaaaaggaatcagtttgagaaaagcgcaggagatttcagatcagatagtggaaaaatcagatatgcgaaaagcaatgatgtttcttcagcagtatggaatttctctggcacttggaggaaaaatttacaagcagtatggaccacagatgtatcatgttttaaaagaaaatccatatcagatggcagaagatgtagaggggatcggatttaagattgcagatgagattgcaggaagaattggaattttaccggattcagattatcgaatccgaagcggacttctttacatactgacgcaggcatcggcagagggtcatgtttatcttccaaagaagcttcttttaagaagggcatctgcgcttttgtgtgtggaagaatcctacatggaaaaacatatcatggatttggcaattgagcggaaggttgtaataaaagaaattatgccgggggaagaagaacaggagcagattgtgtatgcaagccagttttatcaggtagagctgcatgtggcacagatgttaaaagaactggatttaaaagaagaaatcaatcaggataagttaaagcttcagttagatgaacttgaatcagcagaagaaattacgctggatgaaaaacagagacaagcagtaatgcaggcagcctcaaatgggctgcttgttgtaacaggtggaccgggaaccggaaagacaacgactattaatgcgattatccggtattttgaacaacagaatgaagaaattcttttagctgcgccgacgggaagggcggcaaagcgaatggcggagacgacggggtatgaggcaaaaactattcaccgtctgttggagctttccggtatgccggagaatcagacaaaaaaaggaattcattttgaaagaaatgcgcagaatccattagaagccgatgtgattattattgatgagatgtcgatggtagatatttttttaatgcatgctctgctttcggcgattatgccgggaacaagactgattttggtaggagatgtcaatcagcttccaagcgtgggcgcagggagcgtgttgaaagatattattttgtccggtcagtttgccgtggtagaattgacaaaaattttccgtcaggcttcccagagtgatatcgttgttaatgcgcataaaatcaataagggaataccggttacactcgataataagagcatggactttttctttttaaaacgttacgatgcaaacgtgattatccgtgtattgatagcgctgattcagaataaactaccgaaatttgtaaatgcgactccttatgaaattcaagttctgactccaatgagaaaaggacttttaggtgtggaacgcttaaatatggttttacagcagtatttaaatccgccagataatcagaaaagagaaaaagagcacagacagggactgtttcgtgaaggcgataaggtcatgcagattaaaaataactatcagacagagtgggaaatccgtggaatcgggggcatccgtattgaaaaaggtgtaggtgtatttaatggagacaccggaattatcagagaaatcaatctgtttgcggagacgctgacggtcgaatttgaagagagacgttttgtagaatatccatttaggcagttagatgaacttgaacttgcttatgcaattacgatacataagtcacaaggtagtgaatatccggcagtagtcattccgcttttgaatggaccaaagatgttaatgaaccgtaacttattatatacagcagtgaccagagcacgaaaatgtgtgactttagtaggagatgaaaaaatattctgggaaatggaagaaaaccaaatggaacaaagccgttacacgacactcgatttaagattaaaggaaatcggattacagcaggaattttagatattctttatccaaggaggtgtccggtgtgcggagaaatcgtagcacaaagggggcgcagtatctgtaaagactgcgccccaatgttaaaaccgataaaaggagttcgatgttaccgctgttccagaccacttttagaggaacgacaggaattttgctatgactgtagtagaaaaaaacatgtttatcaacagggaattgcggtgtttgggtatcaaagtccggtggcgcagtccctttatcagttaaaatatcatgcgagaaaagagtatggaattttttatgggcattatgcggcagtgtatgcaaaaaaacaaattcaggcatggaagattgaggtactgattccggtgccgctgcatccgtcccgtttggcaaaacgtggttataaccaggcagaggtgattgcaagggcgatgggagaaaaattaaatcttccggttgtgacggatgcagtaaaacgagtggaaaaaacaaaaccgttaaaggaattaaatccacaggagcgcagaaaaagtcttcagagggcatttatgccggcaaaaaatcaggcgcactggaaaaatgtactgattatcgatgatatttatacaacgggaagtacgattgatgcagtcagtcgggttttaaaagaaacacaaagagcagaagctatctattttctgacgatagcaatcggtattggaaataattagaaaataatcagaaagaaattgacaaaaaatttttcatagaatataatggggcaagaatcgggaggtaaatcattttgtttcataagtcagcacagtgagtacttttacaggagctgtgctttagaaaagaggagtaaaaatgagaaaaaaaacattgtttatcgtactatgtctgctttcaggaattctgactcttggtggatgtggaaagtcagaaactgatgatgccaaaacacagaaaagtgaagcaaaagaagaggatgaatgggaagaaactccggttgcaccaattgaaaaagaagatttgaaaaaaatcggagttccgctgaaggggactgttgagataaaactggaaaataatactggaaagagtattaccggatttgcagttaagaaaagtgaaaacagtgagtttggtgagaacctgctcgaagatgaggatgtttatgtcaaaggtgagaagcgttatttttactatgactataagcaggaaaattcagaagaagaaacggagacgatttctgcagattacgacggtaatacagaggaagaaacagacgaaagtgtacctgaatatgatattcagattacatacttaaatggtaccaccgcagttcttcataattttccgtttgatgatatgaaagagggtacattagagttggaagatgagattacttatctgacttatacaagtatcaagacgaaaaaagaagtcgatacaaaagacgaagagcgcagtatcaggacaaaagaagaaacagcagcggcagaagcgcagagaaaagcgaacgaggcggcagcagcagaggcaaaacgtcaggcagcggaggcggcagcagcaaaacagcaggcagaagcagcggcggcggaagcacaaaaacaggcgcaggcagcagcagaggcacagaagcaggcacaagagcaggcggtacaacagcagcaggatgcaaaccagaatcagaatcaggatgcaaaccagaaccaggacgcaaaccagaatcagaatcaggatgcaaaccagaatcagaaccaggatgcaaaccagaatcagaaccaggatgcaaaccagaatcagaatcaggatgcaaaccagaatcagcagacgcctgataatacaacgacagatagtaatacaacaacagaaactcagcaataagaatcaaaagaaatgaaataaagaaaaaacagataaaagagaccattgaaaagagaaatgttactaagaacaaagagaacagtaacaaagaaacaatggtctcttttggtatgcgcagaaagggttgcttcgtctgctttaagtatggtataatataaaacgtatgattagatttgctttaagaaagcagagggaaattagatgttaaatgaacagaaaattaagaagatgagaaagctggccacctatgagtcaggcaagggtcgtaagcagcttagaatcagtaagtattatagaagtgattatatcgggctttccttgattaagaatttttttcttactacaattgcttatggtttgctgcttctggtgtatttcggaagcaaaagtgattatctgatggataatatcaatcagatagacgtggttgcactcggggtgaaagtaattttgttttatctggttatgattgcaggatacagtattattacctatgtgtattgttctgtaaagtacagacaggcacaggagggggtagaggagtactatcaggaattaagccagcttaaaaagatgtatgacagagaagaaacaaaagctggtaaagcggctaaaaggaggaaggcataaggcatgacgaaactattactatggaaacaaaaagtgaaagaattttatggagagcatgatttctggattacgcctttatttaaattccttttggcatttgttgtattttcacagattaacggtttattaggatttatgagacaaatcgataacatttttgttgttttgattttatctttgatttgtgcaatgttttcaattaatgtgatgaccatattggcgtgtctcctgattcttggtcattgttatgcagttggaattgagacggcaggatttgcagcagtcttactgattttattactgattttatttcttcgttttacttcagaagataatgtcgcattgattcttacaccgatttcttttaccctgcatattccggcagcagtaccggtaggctgtggcattttaagaggagcatcaagcgcagtaccatccggatgtggggtaatattatatttctttatgaaactggtaaaagacagagcaacggtacttcagggaaatgaaacggagccactgcagaaattacagcttttattagacggtgtcttaaaaaatgaagaaatgtggctgacagttgtagtttttgcagcagttgttgtgattgtaagtgtcatcagcagagcgtcttttgactatgcatggagaattgcaattgtgacaggtgcagttgtttatatcgttatcatggtatttggaagcatgttcatgagcgtcagcacggaacttgcagggattattttatctggtgtagctgcaattattattggatttgttattgaattctttgaactgggtgtggattattcaagaacagaactgactcagtttgaagatgatgaatatatctattatgtaaaagcagttccaaaagcactggtttccgaaagcaaaaaaagtgtaaagaaatttacaccgaattctaaagtggtggaagaagtaaggctggatgaagtcagacaaaataaagaaacaaaagcgtatcagcaggaaagtcagcatcaggaaataaaaccaattccggaagaaaatctgagtcagaccgaaaaagcacatacacaggatttttcagcgaaacagaacacagcacaggaagaatcggaggcagttccggtagaacgtgtggcagaagaagattttgactttgaaaaacaattagaggagtctttaaaaaacttataaaaatttcagattagagaaaagaactataagggggtgagactgtgggagattttttattatccgtaacaagttacttaacaggtatccgattaccgtattttacgtggagtgatattgttgaaattctgttgattgctttctttgtatatgagtttatgttatggattcgtaataccagagcatattcgcttttaaaaggaatcttaattgtgcttgcatttattttcattgcatttttattgaagatgaatacaattttatggctggttaccaacatggcaggatatgcaattacggccgtattgattatttttcagccagagcttagaaaggcacttgaagaactgggacataaaaaaatcgtaagcagtatcattccatttgattcaggaaacaaagaagaagacggatatttttctgataaaacaattaacgaaattgttcgtgcaagttttgaaatgggagcagtcaaaacaggagctttgattgtaatagaagaagaaaccattttaaatgaatatgcgagaaccggaatttatctggattctttagtaagcagtcagcttttgattaatatttttgaacataatacaccgcttcacgacggagcaattgtcattcggggagacagaattgtggcagcgacctgttatctccctctttctgataacatggcactgaataagaatcttggaacaagacatcgtgcaggagtcggaatcagtgaggtcagcgattcttttacaattattgtatcagaagagaccggaaatgtatcagttgcaaaacagggcaaactggatgttgcattgacaaaggatgagttaaaagaacgtctgaagaaagagcagaatgcgacaccggagaatgcaaaacggaaaaaaataatatggaagggatggggaaagaatgagaaaaaatctgatgaataaatttactcttagaattctttcgctgtttattgccatatttatttggcttctggttgttaatattgaggatcctgtaaggacaattacaattaccgatgtaccggttacatttgcaaacgaatcttatattgaaagcatgaataaagtggcgcttatggaagatgggaaagatactgtggatgtcaaggtgacaggtgcaagttcgattatgaaaaaaatcagcagggacaatatttcagcggtagcggatttaacccagattgtagatctggagtctgatccgattatggttccggtctatgtcagctattccggtattgaagagcacaacatagaagcaagaccaagaaatattccgattacaattgaaaacagagtcagtcaggaatatacaattgcagtgaatacaggcgatacgaaaccggaaaaaggatatgaagtcggaaaaacggaaacaaatccagaccgtgtgacaatcatcggaccagaatcgattatgaataagattggaaatgtcgtggctcaggtagatgtcagtggaatgtcaaaggatgataccagacagtctgagattaaagtttatgacaaaaacctcgaagaactttctgaaaagcagatgtcgtatctgaagtttgatatacagtctacaacaatagatgtaaatgttgaattatggaaagtgaaacaggatgttccggtggaagtgaaatattccggaacggtaaaagcgggatattatgtattccaggtttcttctacgccgaataccatcagtattgcaggaacgcaggaagccttaaaacagtttgaagaggatggagataaactggtaattccagcatcactggttaatatcagtggaaaatcttcggattatgaagtaaaagtaaatctcgaagatttgcttccggaagatattgaacttgcgacagatatcagtgagacagcccttgtgacagtgaagattcttccgttaaatagtaaagagtatgaaattccggtaaacagtatcacagtaaataataagccatccgatacggatttggtttttgacagagagaaaataacagtaagaattctgggaacggaagaagcacttgaaaatctgaaagaagcgcagattgcgttaagtattgatttaaaatcttacggtgtcggagaatatgaagttccggtacagattacacttccggatggatatacctctctggatacggtgaaagtaaaattaaaactggtgaaagccgcagaaattacgacgggatagtggactttgaacacagatttacaataacagaagcagggagtgagaaacatggtaagccagaaagtaaaagtaaataatttgattggtctgcacttaagaccggcaggaaagctttgtaatgaggcaatgaaatataagtgtctgattacctttcattataaagacgtgacagcaaatgcaaagagtgtgctgagcgtacttggtgcctgcgtaagaggtggagcggtcattgaactggtatgtgagggagaggacgaacagaccgctttggaacatttggttgatttgctggagcattcacttcaggagtgaaccaccacacgccataaaggcatgtggatacacggcgacagaaacttataaagaaaaataagaatagaaatacaaaagtgctggggcaaaaattttgaccccagcattgtgctgtaattatgataaaaaagaaaaaatacaaaatgggggataaacatgcagaataatataaaacaaggcttaaaagatggaattccgattgcacttgggtatttttctgtcagttttacatttggtatgctggcagtgaatcatggaatgaaaccatttcatgcagtattgatttcactgttgaatctgacatcggcaggacagtttgcaggacttaatgtcattctggcagggtcttctctggtggaaatggcactaacccagcttgtcattaatatgcgttatgcgttgatgtcactgtcactttcacagaaatttgcacgaagtgttcataccggacacagactggcgattgcttatggtatcacggatgaaatttttgcggtggcgagttctaaaaaaggaaaagtgggtcagtggtacatgtatggattgattttccttccggtggttggttgggtatccggaacgcttggaggtgcggtggcaagtacaattatgccggaatttatcagaagtgcattgggtgttgctttatacggaatgtttgtggcgattgtcattcctccggctaaaaaagagaaaaatgtaggtattgttgtaattaccgcattgattttaagtacaggattttattatctgcctctgctttgtaagatttcagatgggtttaaaattattatctgtacgttattagcagctggaatgggcgcagtcctgtttccgattagggaggaagaatcatgatttatgcttatatttttgtgatggcaggagtaacgtatctgattcgtatgcttccgctcacattatttcagaaaaaaattacaaatgtttatatccgttcgtttttatattatgtaccttatgcctgtctgaccgctatgacgtttccggcaattttgtatgcgacagattctccaatttcagcgtttgcggggctggtagttgcagtgattttcgccctgaaagaaaaaagtcttgtaacagtagcgtgtttctcttgcatagctgtgtttgttatggagagaattttatcatttctgtaaagaaaacttaatattgttttacattctgtttgttgtaaaaacaggtcaaaaatggtaaaataagtaaaaatcaggagataccaggaagcgagggataggtatgaaaaaaagaagaatgaaactgttatccttgatgcttaccgtggccgttactatgacaacggtattgccggtaagtgcagcgactgtatcagaaggagcggtacagagccaggaaagttcacaaactcttttagagggacaaccggatggcggacagcaggaagttggagagcaagagacaggagaagaaactccggatgtgaaagaaactccagatgtgaaagaaactccggatgtgaaagaaactccggatgcagaagctgaggctccgtctgaggatatgaaagaagagccgaatgagactccggcggatgaggcaaagacagaagaaccttcacaggaggaactggaagaacgacagccgacggatacaattactgtactgaaaaataatgaattaaaaggtgaaaaaattgatgaacactggacgttagaaactgtagtggatgcatctaataaagcaaaacagataatttatcgttattatgaaaatcttacaaatgcagacacgctgacagaaaaatgggtgtttgaagtagaaaaaagtatctggataaaatatgaggctgaaactgatgtaacaccggttgttttaagtgaagatgtttatcagattggaaaagacagttattatttaaatgcaaagggtcaatttgcatccaacgcatggaaaaaatatagaagtgaaaccggaacagagtattattattattttaatgcagaaggaaagaaagatgcttctaaaacaggactccgtacagatattgaaaatggagtaacttattttctggaagaaaatggagagatttttaaaaatggtcagaaagtcataaatggagtgacttatgtctttggagcagacggaaaatgtacttccaattataaaccgggctgggaaaagacagctgatggttggaaatggaaacaggctgatggaacatatgcggcaggtacctggattttgacaagtggtaaatattactatctgaaatcgaacggaatcatggctacctactggacacaggtagatggaaaatactatttccttggcgcagatggttctatgagaacttactggcagaatatttatggtaaatattattggctcggaagagatggagcaatgaaaaccggctggcagcaggtttatggcaaatggtactatcttggaaaagaaaatgatggtgcgatgaaatattactggcagaaaattgacggtaagtattattggttaggtcatggaaatgatggcgcgatgaaaacctactggcagaaaatctatggaaaatattatttccttggcagtgacggctctatgagaaccggttggcagaagatttatggaaaatactattatcttggcggagcaagtgatggctctatgaaaaccggttggcagaaaatcggaaataaaaagtattattttggcggagcaaacgacggtgtcatgaaaaccggctggcagaagattgatggcaaatattatcatttcggaggtactgcagacggagcaatgaaaaccggttggacttctgttggcagcaaatggtactacttagacagtaacggagtgatgcagactggttatattaaaaccggaaataccagattttatatggatgcgaatggtgttatgcagaccggctggcagtatgtcaatggatataaattatactttaaatccaatggagcattgcagcaggatgtcagcagtatggtaagcggaccatacagactgcgtgtaaatcgtacgacctgcatggttactgtatttgcaaaagatggttcaaacggatatattattccggttaaatcaatgacctgctctgtaggacttccggcaacaccaaccccaacaggaacattctacattggtgaccaggacagatggcatatcttaatgggtccatcctggggtcagtatacgtctcatgtatatcagggaatctttattcactctgtagcaggtggacggcagaacatttataacttaaatgcagcagattacaataacttaggacgtccggcatctcacggatgtatccgactttgtgtaagagatgcaaaatggatttatacaaatgtaagcagaggttcacagattacaattggtgatggctattatgagccatttgataaaccggctacgattaaacttgcaccgggaacaaatcttatggacccgacccagtgttaagcagataccgactaaagaaaattttgtttttagattttgcttaaaaaagaagagaggcgtgtttttttgacacgtctcttcttttcgcttataatgtatagaaaggtacgattgagaggcgaaaaaaatggaattggaaagaacaccaatttatgagatttttgacagaaaacagtcgggaaatcagctctatatcatgagagaagatttactgccattttcacttggaggaaataaagtaagaattgcaaatgccttttttgaagatatgcagaaaaaaggttgtgatattatgattgcttatggaaatgtgcgatctaatttatgcagggtgattgcaaacgaatgtttcagaaaaaagattccctgttatatgatttgttcatttgaagagggcgaaagtgaggaaaaagagacaagcaacagccatttgatgcagatgcttaaggtaaaaattgtaaaatgtagaaaaaatcagattgcagagacagtagaggcaacgatgaatcggttaatacaggaaggacacaaaccgtattatatctatggaaataaatttggaaccggaaacgagggggtttctgcttctgcttatgcaaaagcttatcaggagatcttgaattttgagaaaaaccaagggattttctttgattatatttttcatgcatcgggaacaggagcaacacaggcaggtctgacttgtggacatcttttggcgagagataagaagcagattgttgggattttgatttcctcaagagagtatgaacgtgcggtttcgattattgaaaccggaatgagagaatacttaaaagggcttggaaaagagttttccatggaagaccaaaaagagatccatctggcaagtgagtatacaaaaggtggatatggacagtatgatgaggaaatcgagcagtgtatccgtgaggagtttgccttaaatggagtggcaatggatggaacttataccggaaaagcatttcttggaatggaacactatatcgaagattatcagatttctggaaaaaagatattattcattcataccggaggaacacctcttttctatgactggcttggtacacaaaaaaaagatttaggaaggttataagaaaaatgctgatttctattgtaataccttgttattattcggaaaaaacaattcagaaagtagtcgagctgacgattcaggaatttcatgcacataaaaaatatcaatgcgagtttgtcctggtaaatgatggatcgacagatggaacgtttgaaaaaataaaagaattagcaaagaaatatccatttgtgcatggagtcaatctgattcgtaactttggacagcataatgcactgatggcggcacttcattatacaaaaggtgattatgtactcggaatggatgatgatatgcagacgcatccttcacagatttttaagctggtagagaaaattcaagagggatatgatctggtttatggacattatggaaaacgaaaaaattcttctctcaagaacttaagcagtaaattaaatgaagtttcttcgagaattttactgggacggccaaaagaaattacttcaagtaatttttggattatcaccaaaaaagtagcagaagaaaccaggaaatatgacagttataatccttatattgatgggattttttatcggattacccacaatattggaaatgtggaagtggaacatcataaaagagaagttggagcatctaattataccctgcataagctgattcatttatggctggcatattggaattattctgtaatcccgcttcgaatttcgtctgtggcaggtggaattgctgccggagtcggatttttgatggcagttatcacagcgatacgaaaaatcgttgacccgtctctggtgattggctgggcgtctatgatgtgtgtgacgatggtatttgcaggcatgattttaatgtgtcttgggattgtcggggaatatcttggaaaaattattcttacgctgaatcatactccacagtttattgtaagagaaacgataaatgtaagcgaacaaagggaagaaatttgaccgaatcaagaaagttggcaaatcagctaaatgggagttattttgaaatgtcaaagaagaaattaatgatattaggagcaggaatctatcaagtgcctttaataaaaaaagcaaaagaaatggggctggaaacgctggttgtaagcataaaaggaaattatccgggaattgcgcttgcggattctttttatgagatagatacaagagattatgaaaaaattttagaaaccgcaaaaagagaaaagatttccggaatctgtacctcaggaacggacgtggcagtgcgtgcgattggttttgtctgtgataatctgggactacgagggattccaagagaagcagcgtggaaggtcacggataagcttttgatgaaagaggcattaaaggcaggaggggtatcaaccgcagattttagaaaggtcgcttcttatgaagaatgtgttgagtcggctaatgcacttggatttccggttatggtaaaagcagtggacagttcaggaagccgtggaatccaccgtgcagacaggatggaagaattagaatatgcctggcaggaagcaaaaaaggtaacaaagaagccgtatgtgctggtagaagaatttattgaagccgatgaaataggggtagatgcttttattggagaagaaaaaatagaagcattttttccacatgaaaaatttacttatacggtaaatggaacaacgatgccaatcggacataaatttccttatcatgcatcgaaaaaactgatggaaaatctgaaacatcagattgagcttgccataaaagcactgggaatgaaaaactgtccgctaaatgccgatgtatttgtaagaggagagcaggtctggctgattgaagttggaggaagaacaggagcaacctgtattccggagctgatttcaatttatacgggttatgactggtatgaaaagataatcagttatgcacttggcgaagaggcagagtttcagagtgaagaaacacatccttgtatgggcgcattgctgttttcgaatcaggatggcataatcgaaaagattgaaatggataaacttaaaagcctggttcaaaaaggtattgaggttcagcttgattatcaggtcggtgataaaattgaggcaatgaagaatggaacagatcggattgggcaggtcattatgaggacaggaagcgaagcggaattagaagaagcgttaagccatgcaagagaagcagtctggctgtcgaaaggaaatttggaagaacgatggaaaaattaaaagattatatcttactgcatttaaatatcatgctgttttcatttaccagtgtattcagcaaactggcatcacagcagtttaataaacacggactgttttcagcaggaatgattggattttcttttttgatgttattaaactgctttgtttatgcaatcgcgtggcagaaggttatcaaaaaatttgatttaaatgttgcttatgcaaaccgtacggtatatttaatctggagccagatatgggctgtttttatttttcatgaaagtcttacagtgacaaatatgattggtttgctggttgtctttattggagtgttggtggtgcagaaatatgaataattatatgtggctgttatttatcggaacatttttcagtgcattctcacagctgttattaaagcagagtgcaaataaaacctataaaaatccgatttttgaatatttaaattggcgcgtgattctttcttacggaatttttgcagccgttttgtttctaaatacttatgcgtatacaaaagtagacatgaaatatggtgcagtaattgatacctttacttatgtgtttgttatggtattgtcgtattttattttaaaagaaaagtttacaaaggaaaaattaattggaaatttgattattatgagtggagtgtttatttataccctgccgttttaatcttccaaagaagaagccgattatgagatgtataaatataagaaacggatttatagagacagagtataaaagagtggaacagattgtagatttggcaaaatgttccactcttttaaaatttttaccggttgaagtaatcaaaaattgttttaacaacatattctttatccgcttgtgacagctggtagtacatcggaagacgtaccagacgttcactttcttttgttgtatagcggtcttctccaaagaaacgtccgtatttttttccggctggtgcagaatgtaatggaatataatgaaaaacagacatcacaccgtgttctcttaaataatgaataaaatcagagcgactttccaggttcgggagtttgatatagtacatgtgagcattgtgaatacaatcttttggaataaaaggctgttcaatcaattccttatcggcaagtggttttaatgcttcattataaaagttccaggtggccatgcggtcattttgaatgtcatctgccatttcaagctgagcccaaagataagcagcatttaaatcgcttggaagataggaagaaccataatcctgccaggtatacttatcaatctgtccacggaaaaatttactgcggtctgttcccttctcacgcagaatttctgctttttcctgataagcattattctgaaagaataatgcaccgccttctcccatacttaaatttttggtttcatgaaaactaagacagccaaaatctccaattgttccaagactttttcccttataataagaagcgaatccctgtgcggcatcctcgacaacttttaagtgatgacgctttgcaatattcatgattgtgtccatatcgcaggcaactccggcataatgaaccggaacaatcacttttgttttttcagtgatggcgtcctcgatcaatgtttcatcaagattcatggtatcaggacgaatatcgacaaagacaagggatgcacctctttgaacaaaagcatctgctgtggaaacaaaggtgtaggagggaaggatgacttcatcccccggttttacaccgcttaagacagctgccatttcaagtgcatgagtgcaggacgtggtgagaaatgcctgattggtataaaaatgttctttcatccactgactgcattttttggtaaatgttccatctccgcagatttttccgcttgcgatggcttcttgtatgtattttacttcatttcccgtatgaggggcaatattaaaatcaatcataacgactcctaaaaattttgttctaaatcaaataactacggtaacattttaacatagttaaaaaaaaacgcaaatattaatttgatatacattgcaatttaaaaataagtattatataataggaaatacttggttaacatatatgtaataaatttggaaaaagttgacgcaaagcaaaaagggaagggtaggaaatgaaaaaggcaacaaaaaaatggattgcttacttgttgacactgacaatgctattatctgtagcgactccggtattcggagcagagccagggacagaagaggctgtgccggaaactgtgcagacacaggaagcggtgcaaagtacagaaaaaagcgcagatgaaatttcacaggaacaggtttcggaggaacaaaattcggaggcacagagtacaaacgaacaggatacggaagagcagaattcgaaaacttctgatttagaaggaacaaattcggaagaaacaaattcagaagaaatgaattcagaagaaataaattcccgggatgctgtttcagaagtggcgtttaactatgtggttactcaggatgatggaatcaatcagtctgttattatgagctttggagacgaaacaacagtgattgagagtgcagtacttacataccgtgacggaggagagataaaaacagcagagtcagatactgtagcagagaactttgccgtttttttgcttccgattgcacaggatggagtggaacgtgtatgggaaagtgctgtagtgagaattacagggattgagtatactgtgtcacttcaagattctgaaggtatgacgcagacagaagtttcagaagaaaccgcttcagaagtattgcaggatacagaagagtctttagatgaagagactgttaatctggtagaagattctatcatttccacaaagggagacggaattacgggagaggaaattgcggattcaattgaaaaatcaatagaactcgttccggatgcagacgtaacagctcaaatcagcacattttccatggagtctgtgggaagagcagcacagaagtatgtgattgtgttagacccaggacatggtggttatgatggaggggctgaaaatcaaaatggaatttcttccgaatctgaatcaaagttgacattaaaaattgcaaattatgtaaaacaggagttagagaaatcatcacagtttgttgtctatatgaccagaacggatgacagctatgttgggttaagtgaacgtgtaaattatgcggcatccaagaatgcagatattttagtaagcctgcatttaaattccgcagattcaaaaaccgcaaatggagcagaaatccttgtaccaagaacaggacgctataactctaaggttgcggaaaatgccggacaactggcacaggatattttgaaaaaactggtaagtttaggcttatacaatcgtggactggtttatcgtgacagtgcaagtggtacaaaatatccggatggaagtaccgcagattattatgcaattgttcgtcagggattgcaggcaggaattccatccattattgtggagcatgcatttatcagcagtacagtggatgcaaagtttttagacagtgaagcagatttacagaagattggaagagccgatgcagaaggaattgcacagtattttggtgtgacactttcgaattcttctaataataacagtaatagtaattccagcaattcagacaagaatggctgggtcaaagaaaatagaaactggtattactataagtcaaatgcaaaacagacaggctggcagaaggttgatggaaagtggtattatctgaaggcaaacggagtgatgcaaacttactggtatctggaaaatggaaagtattatttccttggagcaaatggctctgtaagaaccggctggcagaatatctggggaaaatggtattattttgacagtgatggagtgatgcagaccggttggcagaagataaaaggagtctggtactatcttggagggtcttcggatggagcaatgaaaacaggctggcagaagattaatggaaagtggtattacttaaaggcaaacggagtgatgcaaacttactggtatctggaaaatggaaagtattatttccttggagcaaatggttccgtaagaaccggctggcagaatatctggggcaaatattatcattttgacagtgatggagtgatgcagaccggctggcagaaaatcgatggagcatggtattattttggaaatgagaaaaatggtgcaatgcaggtgggctggcagatagttgaccatgagtactattacatcgtggacagcggggtgatgcaaacttactggagaaaaatcgacggaaactactatttctttggagcaaatggtgtcagaagaaccggttggcagaaaatctggggaaaatggtactatctggatgaaaatggagtgatgcagaccggctggcagaagataaaaggagtctggtactactttggcgggtcttcagatggagcaatgaaaaccggctggcagaccattaatggaaagacctattattttgactcagaaggagcaatggcaaccggaaccgttacaattggcggaacaaagtatgaatttaacagcagtggagctctaaaagaagaaacaaaaaatgaagggttatatcagattacgggaacaagcagtgtgactgtttctcagatggtaaaatattataatacatactcttcgattgcttatccgtctgcagcgctgaccaagggtggtgcagcggatattgaaacattttgtaaaataataaaagaagaagccgatgcagaaaacatgaaagccgatgtagtatttattcaggcaatgttagaaaccggatatctgaaatttggcggagatgtaaaaatcagccagtttaatttcgcaggacttggagcaaccggaaacggagttgcaggaaattcttttaaggatgtaagaaccggaatccgtgctcaggtacagcatttaaaagcttatgccaataaagaggcgttaaaaaatacctgtgtagatgttcgtttctcttatgtgacaagaggaagtgcaccttacgtggaatggcttggaattcaggaaaacccaaatgggggcggttgggctgcaagcaagaattacggtaatgatttactgggattaattaacaagttaaaagcaatttaaaaaaacagacaggatgatgtcaaaatcctgtctgtttttttgctgtatttagatttaattagaacccatcagttctccggaagcagagaaaacataccattttttgtcgattaatttcagtccggtctgcatcactccggattcgtccagataataggttttgccgtttgaggtaacccatccggtctgtaacactccactataatttgcataataccatttgccgtcaacagagaaccagtatttctgcatcactccggttaaaggcataaggtaataacgattcttgccgtttgtataccagccttctatgcgtgcaccatttgactggagaagataccagttattgtcaattttctgccatccggtcagcattgctccagaggaatttaagtaataccatttgccccagatgctctgccatccggttcgcatgataccgtctgaaccaaggaagtagtaggcattattgactttctgccagtaggttttcatagctccgtcatttgcattgccaaagtaataccatttagaatcgagtcgtttccatccggtctgcatcagtccattagtttcaaaataataagttttgttattgagtgtctgccatccggtttttaaggttccgttctcatttaaataataccactggttggtaccgattttgatccatttggttttcattctaccgcttgttgggtcaaagtaataagttttgttgttaagtgtctgccatccggtctgcatgacaccgctcttatttaaataataagtctgggtatacagatacatccatccggtctgcatgataccattactgttcagataatgccagctgtttccaacttttacccatccggtctgcatgacacctttctcattcatgtaataccatttttgtctgtgataaagccatccggtctgcatcattccggatgaatttaaataataccatttatcatcgatttcacgccatccagtctgcatgattcctttttcattcatgtaataccagtattttccactttttacccatccggtctttaagattccggttgagaggtcgaaataataataagtttgattaagatacagccatccaatatgacgatatccggtggaatcaaaatagtatttttctccatcaatggtttcccatccattttttgtgtagcttccgtctgcgtgaacataccaccagccatttttatcctgtttccatccagttttggaggttgtggttttggaagtgtcccagactccgttttcatcaacataagatgttccaatccaggcattttttgccatggtgccgtctttctggaaataatagcattttttattgatccatttccacccagccgaaagcatctgaccgctgtcattgaaaaagtaagtatcctcatcaatggtgcagagtccggttgaaatactgccgtcattctttaagtaatagtaatagtttccattttttaaccagccatgaacgagtgcaccttttgcatcagcataataccaagttgcatttgtgcgaatccatttcttttcatctgcggtaatggaattagaaaaatgataggtttctccatcatagtccacaaaaccggtgtaggctttttcacgtccatttaaataactggaaagataaggcgtctcgtctttactgtaaaagaaataatcagaagaagagacatttaagtccagcgtatccatatccagtgtgattgcaggagtgtatgaagtatattctggaagagagtaaagtcttgttccaagtttatttaaaagttcaattctgtcttccggaagaaccttgtaaagccctgactgaatggcaattgttggacttaaggtatttagatattccagagagtttgaatttgcgattccatgatgacccagctttaagacatcaatatgtcccaaaactttggaaagacgtgcctcatctccatctgcaaaaccgatatcgccgctaagaaaggcagtgtatccactgtcggaagtgacttttacgccaagagaaaaatagttggcatcgagttttccggttgttttgtaatcatcactgtagttcatcacctgaagatgcaagtccccaaggtcgaagtctggatttccggttgtgcttgcaggtgtgctgtagactgttgagtttggatcagaagaattcagtacagcaattccttcttcggggaatgcctcttccattgcagggtcatcttcagaaaccggagaatctccatatttttcttcaatttcctgttctgtaatataagaataagaacgggtatccgtaccggcagaaatattttgttcttcggtctgagcggaagcttcagcagcctggtctggaacaaccggtgcattgacatcgaagttctgaatcaaagtacttccaacttctttcgctgcctcaactgctttatcgtaaacatagagattgtcaaataacagtccgggtgaagtgatgtattcatctttgtattccatcagatagactctttgaggatgaaattcccgaatgacttcatccgcagaaccgatgtggtcactgtgaggatgcgttccaagataaaaatcaaagttatcctgcgtgacaccaacactgtgcatgtaatcaagtacctgttgttcatagccctttccggtatagacattgtttcttagtggatagcgtgggtcactgccatccggataatcgctgtcttctccggagtcaatcattccaaagtgtccattgctttcaagcaggatggcatcactgttatacggaagagtgataaaatgaatttttgaataagaaacttccggttcttcttcgctgtcgtctttatcggatgaatctggattttgggtatcaccggaagaatccgaattatctggattctggatatcaccggaagaattcgaactatctggattctgggtattaccggaaaaattcgaaccgtccggattttgaatatcaccggaagaatccgaagaaccggatgaatttgacgaatctggattctgactgcttccggacgaatcggaagtatctgagtctttgagttcatcctcagaggatgatttcctggaatcagaggcatcttctgaagtgtttgaagagtcggcagattctaaagcggaactgccagatacagaggatgcagaaaccggaacagaaccaaatacagttgttgtgctaagcagcagtgccaggaatctggcaaaataaggtttctttttgtgcatagataatatccctttctattctatttgtatgcattgtttttgcgtcttatcctgctattataagctattttttgtcgaaaattcaatagttatgtagaatacaaagagagaaaaacgaaagagagacagattctggcatttgcttttatacaggaaatatagtaagatacttcgagagtggttaaaaaataaaaaatggaggtttaagatgcaggaaattacagagattgccgaattaaaagagatacagcttggaatcttaagaaaagtagatgaactgtgtaaggcacatcatctgaaatactttatgtctgatggaactctgcttggggcagtccggcataaaggatatattccgtgggatgatgaccttgatatatggatgccaagaaaagactatgagaaattagagcagattatgaatcaggaagactcctgctataaagtagtcaatcataaaaatacaaagggatatatttatgcctttggaaaagcggttgatactcgtacaattttaaaagaaaatatcgaagtcaattgtccaatgggaatttatgtagatatttttccttatgatggactccctggggagaaaaaagaggattatatcaaacatgtcagaaaatgtttgtatctggaaaaacagcgttacagagggtttcagagttttaaaggtgtaaaaggaaaccatactacaggaaatacaaaacggtttgtattctgggctgtcagaagactgattggcggaaagaattttatccgtatggtagaccatttaagtcagaagtatccggtagagggggcaaagtatgtgggctgtctggtgggcggttataaagaaaaagatatgatgccggccgaaattttttcagaagcagttgaattggaatttgagggcgaatatttccgtgcgccaaaaggctatgatacctatcttacaattgaatatggcgattatatgaccctgccaccggtagaacaacgtgtcacccatcatgattttaaagcatggtggaaaaccaaataaggagaattactgtgaagaatctttggaaatttgtaaaaacttcaggtatctattttataggtacagtattacataaattgattacgttcttcctgcttccgatttataccaaatatatcgacaaagcagatcttggaacgtatgaccttgcaactgcttacattaacttcttgtgttcgattctgtttctggatatctggagcggaatcatgcgttttgcctttgaatatgaaggagaagagcggaaaaagccgattaccagtggaattgcgattttcaccggttctacggtactttataccatcgtgttatttggagcaggatgtatctttgatatcaagtatcttccacttatctatctgtatggtattatgatgaacattcagactttagttggatatcttgcaagaacctatggaaaaaatgcgttatataccacatctggtctggtcagctcttttgtaactgtagcatgtaacattttatttattgtatatttccgcatggattacagtgcactgtttatctctgcctgtatcggatatctggtcaatatcgtagtgcttggatggggaatcaagctgccaaagctgatttctgtgtcagcctttgataaagatttattcaaaaggatgctgattttctcacttccgctttgcatgaattctgtggcatattggtttttaacttcctataaccgtgtcgcaatttcaaatgttttatcagtcagtgaaaatggtctgtattcgattgccggaagattttcttcgtttattacgttgtttacgacctgctttaatatggcatggcaggaaatgtcttattcaagagaagcacagaagcagacgaatcagggagaattttataccactgctttaaattcttatatcaagtttttatgtatggggcttttaatgctgattcctgcaatttcagttatcttcccgattatgattaatgaatcttatgcggacgcaaaacagttggtaccgtattatctgcttgcaaccattgtttcctgcatcagcagtttctttggaaatatctttactgcaattaagaaaaataatgtattgttttataccacagtggcaggaagtgtggtaaatgtagtcagcgtgcatctgctattaccgattgttggggtacagggagcaagtattgccctgtttttaggttttatggtaaataatacgattcgtgcttatctgctgaaaaaagaaattcaggtttcaatcgatttgaaattcattgttgcatgggcaattgtttacattggagtaagttatatttatctgcatgcaaatgccatcatcaatgtgttaactgtttttgtgggaggattgttgactttatttgtattccgtaaggaattaaaggagattttaggtacaataaaaaacagataaatgaagtaaatgttgaatcttcttgaacaaaatgttaagatgaatgttaagagactaagaatattaagaggttggatggatgaaaggtgtaaagagagaacaatttcggcgtttagtcagaagcatagccgtaatgattattctggtactggaatcttttattttttattatgtctggaataaatattacagcagggggctttggattgagccgttctatgcaaaaggaaatattttcattgtattggtgtatgcggcatttatgctgttgtttttatatatttatggtggatttaaaattggttatatcaaaagaggcaatctgatttattctcaggcattgtccggactttgtgccaatgtaattatgtatcttcagattgtgctgttataccgtcgtctgccggatgtgcgtcccttgcttgcaatgacgttggcagatttgcttgtaattggaatttgttcgtatttttttgataagctgttcagttatattttcccgccacgtgatattctgttgatttatggagagtatccggtggaaaaactgggtggaaaaattgcaacgagaaaagataaattccgtattaaagagcggatttctgtggatgaagattttgaaaccattcagaaaaaaattctggaatatgaaaatggtggtgtacttttaggagatattcattcctctgacagaaaccagattttaaagttttgttatgcacattcgattcgtgtgtatctgactccgaaagtttcagatatcattgtaagaaatggagaaacgcttcatttatttgacactccgcttttactgtgtcgtaattatggattaaatatcggtcagcgttttgcaaagaggactctggatttggtggtttctgttttgatgtttattgtggcatctccatttatgctggtgactgcaattgtaatcaaggcttatgacaaaggaccggttttgtttaaacagaaacgtttaaccattgatggaaaagaattttatgtctataaattcagaagtatgatagtagatgcagaaaaagatggtgtggcgcgccttgcaaaagcaggagacagcagaattacaccggttggaaaagtgattcgtgcaacacgattagacgaacttccacagcttttaaatatcatcaaaggtgatatgagtctggttggaccaagaccggagcgtccggaaattgcaaaagaatacgaaaaagaaattccggaatttgcgttccgtttaaaagtgaaggcaggattgaccggttatgcccagatttacggaaagtataataccacagcctatgacaaactaaaattagatatgatgtacattgaaagttattcgtttatcaatgatttgaaattgattttatctacctttaaaattatgtttatgaaagaaagcaccgaaggcatggaaggggaagaaacaattgccttaagccaccagcctgagaaagagaagaaaaatgattagtattattgttccggtgtataaccgtgaaaataaagtaggaagctgtattgcaagtattttaaatcagacgtacacggatttggaattgattttagttgatgatggttcaaccgataacagtgtggcggtctgtgaggaatatgcaaaacaggataagagaatccgcatcattcaaaaagaaaacggtggtgtcagcagtgcgagaaattgtggaatcaaagaggcaagaggagagtacttacagtttgttgattccgatgataccattgacaaagaaatgacgcagaaactttatgaggcggtacaaaaaaatgaggcagatgaagcaatctgtggatttcgtgaaattcatggcgggacaaggggggatgtgattcgcatccctcaaaaagaatgtgtgacgacagttgcaaagatggaatcggaaatcgaacatctgattttgaattgtctgcttcagtcctgctgtaataaactatataaaaaagaaaaaattaaagaatttttttcaaccgagtatacttatggtgaggatttgttatttaatcttgcctatttaagaaagattgaaacgattgcctttgttccgaaagcatattatgaatatgactgccgtggggagtcgattacttcttcttatcgagaagatgagattgagatacgaattcatttaatgagagaagtattcgcatttagcgaagcctgtctggaaggaacacaggtgatgcgcgagtttgctgataagaccatgcgggcggtcatttatagtttatttgatatttatcaggatgaacggttttccaaatcagaaagaaaacagaaaatacttggttatttaaagaatcagacggttcaaaaagcaagcggagtctgtcagcttggaaacagacagcagaggttttgtaatcgtttaattcagaaacagcagggagggttcttactctttttgtttgcattaaaagaaaaattacatctgtattaagaaatggattagaaagaaaaacggagaattgggaaatggcagaatatagtgttttaatgtctgtgtatgcaaaagaaaatccggaatacttaagagaaagtattgaaagtatctggagtcagacggttaaaacgaatgatttttgggtggtatgtgatggacctctgacaaaggagctggatgtagtattagaagaaaatcagaaagctcataaagaggtctttcatcttttacgattaaaagaaaatgtgggattgggacgagccttaaatgagggcttaaagtgctgtaaaaatgaagcggttgcaagaatggattctgatgatattgcatgcaaagaccgctgtgaaaaacagcttcgtgtcttagaagaaggaattgacattgtaagtggtaccgtagtagaatttgagaaagacattttgcattgtaaagcaaaaagaacccttcctttatcgaaggaagaaatcttgaaatttgcgggaagaagaaatccgtttaatcatccatgtgtgatgtatcgtaaagaagcagtggaaaaagcaggaggataccagcatttttatctgtttgaggattattatctctgggcgagaatgttgcttttgggagttgaggcgagaaatcttccggatacccttctttacatgcgtgctggaacaggaatgtacaaacgaagaggtggctggaaatatgtaaaatcaatgttacatttccggctttttttatggaaaagcggtctgagcagtttttgggattttgtggtctgtgcaggaggtcagatgatgatttgtctgattccgaaccgcttaagagaactgttttataaaaaatttcttagaaaatagagagtggcttatgagtagatttttagaaaaactggaatttgtcaaaccggcagaccttgtctcaggacttaagatgctggtttcgattccctatgctgcctgtctgaaaaaaaagagaaaacagatgtggctggtttgcgaagaatataatgaggccagagacaatggttattggctttacaaatatatcagaaaagcgcatcccgagcaggatgtggtttatgcgattaacaaagaatccgtagattatgaaaaaattaaaaatttgggagaagtgattcagtatggctcaatcaaacattgggcatattatctggcagcttcgattaatatcagttcccaaaaaggaggaaagccaaatgcggcagtctgctatttattagaggtctatggaattttaaaaaataccagagtgtttttacagcatggtgtcattgaaaatgatctgccgtttttacattatgaaaatacgaagatgcggatgtttatcacaactgcgccaagagagcatcagtttatctgtgaaaaatttggttatccggatggatgggtcaaatgcgtcggaatagcaagactcgatgggctgcatgatgcaaaagtaaagaaaaatcagattctggtcatgccgacctggagaaaatggatttctgttccaagttccgtttcggcaaccttagacgatatgagcagttttgaggcaacggaatactgcaaacgctggatggaagtcttaagaagcagtgaaattgaagaatggcttgcaaacgctggaatggaactggtcttttatccacacagaaatatgcagaaatttatctcgttttttaagacagagagcaagcacgtaaagattgcagactgggaacactacgacgttcagcagttattaaaagaatccgcttttttgattacggattattcaagtatctttaatgactttgcatatatgagaaaaccgatgatttattatcagtttgataatgaaaaattcagaaaagcacagtatgaagaagggtatttttcttttaaggaagatggttttggaccggtatgtgaaacatttgaagagttaaaaacagcattaaaacgtgcgattgatgaaaatttaaaaaatccggaagtttatctaaatcgagagaaagaattttttacgatttgggataccgataactgcaaacgaaattatgaagagattaaaaaattgcaggagagtctttaagtatgaatattttaattgaaggaatgtcaagacagcttggtggaatggaagcttttatcatgtctgtgtaccgtggactcgaccgtgagagctatcgcatggattttatcgcttatgacgatgagattgtgtttgaagacgaattaaaagcaggcggatctaaggtttatcatgtgactccacgttctaaaagtgttcttcagtcaagaaaagagctggataccatttttaaacagacacagtatgatgtattctggaccaacaaaacaacgattagtaatattgaagccttaaaatcggcaaagaaaaatcaggtaccgcttcggatcgtccattctcattcctctgaaaacagaggaacaaaatttacgctgtttatgcataagaaaaacagacgtaaggtggcaaattatgccaatcagctcttagcctgctcgaaagaagcgggtgtctggatgtttggggagaaagcgaaagaagtacaggttattataaacggagtcgatatccgaaaatatacttacacaaaagaacgagaagagaagatgcgcaaagaactgggacttggagacgaaccggttgtaggtcatgtaggacgtctttccaaagagaaaaatcacagctttttatttcgcatttttcgggaaattcagaaaaaagaatcgtctgtcgttctgcttttatgtggaggcggagatgaagctcagaaaaaacagttagaagaagaggcagaagcacttggaatccgtgactctgttcgttttcttggggtcagaagagatgtgcccgatgtacttcaggtgatgaatgtatttgtatttccgtcgctgtttgagggttatccgatttcactgattgaagcacaggcagcaggacttccgacttttggaagcaaagaagccgttccaaaagaaatgggattgacaaaagagatgcattttctttctttagaggaaggagagaaacaatgggcggaggctgtattaaaagaactccattctgaaaaatgttcggaaaccgaagtgttattacaaagtgaagtaagtcttgaaaagatgcttgacacaattcaaaaaatactggaaaagagagggatgaaacatggaaattgatttagtaatcccatgggtcgatggcaacgacccgaagtggcttgccgaaaaaagagcctgcttaaaagaggaagagggagacggacgtgcaaaccgtttccgtgaatgggataatctggaatatctgtttcgtggaattgaaaaaaatcttccatggattcgcaagattcattttattacctggggacatgtaccaaaatggatgaaagtcaatcatccaaaattaaatattgtaaaacataccgattatattccaaaagaatatcttcctacctataattcccatgtgattgaactgaatttacataggattccagatttagcagagcattttatctatgcaaatgatgatactttttttgttgcaccgatgagaccggaacatttctttaaaaacggtctgccatgcgactgtccgcttgagagagtacatgtctttaaaaaaggtggaattgaccacattgttgcaaatgatttggaattattaaacgaccactttctgaaaaaagatactttgaaaaaataccgcaagaaatggttttccttaaattataaacgattattattaaaaaatatctatatgttaggggtcaagcagttcccaggatttgtcaatccacacattccgcttgcatatttaaagagtacgtttgaggaagtctgggagaaagaaccggaagtattagaggaaacctgtaaacataaattgagaaataatatggatgtcaaccagtggctgtgccgttactggcagtttgccaaaggacagttcgagcctggaaatccttatattggaaaattttattcgattggaaaagacgatgaactcattgaacaggcattgaagacaaaacaatataaaatgttatgtttaagtgacgataaaccggaacttgagtttgaaaaagaaaaagaatggctgaaaaaattattacagtcttattttccggaaaaatcttcgtttgaaaaatagggtactctcaaaatctttatgattgagcgtgcataagaaaggacaagttataaatatgaaactcgatgtacgaaagatgataagcgacccgttctggtttgccatgtacatgcttttaatcgcttatcttggagcaccggcgttcttgaagattcatcttggaattttcagaaaagcaggtctggtatggggagcggttttgcttgccatctttttgataaaaaattacagagcttatctggaaaataaatttgcactggtcttgtttttgttctgtgttgcaaatggaatcacgatacttgtaaactggagaaccaaattaagcagcaatatttttacgtttggttatatgaccacttcactgcttttagtttttaatatgtactggcagaaagaggaagaggaagtggaaaagaaaataaaaattttttcctggatgaatgtgattatgccgcttatgtatgcctcaattgcattaattacatttttactttccgttcaagtgtgttatgaacttccgaatggatatcagtatcttggaatgtttgaaaatcgtctatggggcttattcaacccgaacaccggtggaatgatggcggtgatttccatggcattttcgctttatctgataaacaagtcagcacaaaagaaaaaacttctgattgcaaatattgtaattcaatatctgtatctgattttaacacagtcaagaagtgcttatggagcatttgtcttttttattctgattgtaattggatttgtctgggtcaaaagagagaatctattcacaaaggataggaaaacctgcataaagagtcttttaaagtcagttgtcatttttgcctgtgtgttggcactctctccgattgtaaaacatacgattgtattgattccggatgcagtaagttctttgaaaggacaggaagagaaaacagaaatagtaagaaccgaagaattttttgaagaagaagatgcaaacagtgtcagcaacggacgagtggaaatctggaaagccggattaaaagtctggaaaaattctcctgtatttggtgcaggtgcaaattgcatctatgaatacgcaaagagggatttggataaaggaaccgcacaggcgcttcataatggcggacttcacaatgtctatgtgacaacgctggtggcatctggagtggtaggacttggaattttatccgtctttttaattatggtatttattcgctttgtaagagcacttttcacaaaaacagatacatcgacatttattttaatggggctttgcggtggaattttactatcggattttatggaatccagaatcttatatgcaaactcaagtgttcattatattttctggatgacaatggcgtatctgtgctgtaaaataaatgatatcaagaaaaaacaggcatagagaagcgttaggacaaaagctggaataaataagaaaggatatgaccggatggggaaagttagacgatggatgctgatactgtgtgcgatttttatggtgctcggtgcacagtctgtgtatgcggatgatacgcaggattctctcgatggctactggtcaaaagacgaaaatcaggaaatggaagatggggaaaccgtttaccgatattttctatgggatggaacaatgattacggaccagtgggcaaaaatcgaagaggaatggtacttttttgatgccaatggagtcatgcaaagaggctggctttggaaaagtggtggatggtactatctggatgaagaaaccggtgcgatgcagaaaggctggattaaaatcgagaaagatgagtattttttaagtgagtcaagtggaagaatgaaaaccggttggactcattggaaaaagaaatggtactatctggaatcgaatggaaaactggcaaagaatacagaacgttacctgatggggcatacgtttcactttaataaaacaggagaatgggtaaaagattaaatggaagttgtatcaattgtaaaaatgatactgttcacagtggcattttggttgtttttgattgtcataggatttcatacaccggcaaagcggacgaaaaaaattatagaactgcttatgggtggaatgatattatttttctttttatttgaaatattggcattgtgtgcagttttctttcgatggaaatttcatacgctttactggctggtactgggaatctcggtggtgctgtttgtcagttcgattgttcaaaactgggattttattatgagattaatccggtttaagaaacaggaaacgaaaaaacaaaaaggaagcagactctggtatcttccggcggttgtcttaatagtcgttcagatgtatgcagggattttttacacacacattgacgatgatgatgctttttatgtagcgacggcgtcaacaactctcgagacagatacggtgtttcagtacaatgcgtatacaggagatgagtacgagtcccttccaagccgttatgtattatctccatttccaatttttgaagcgggtttaagcaggctttatggagtaccttcaaccgttttgggacatacgggaatgtttttgatttttcttccggttgcttattttgtttatgacctgctgggcagttttttctggaaaaataaaagaaaagagagaggattgttcttacttcttctggcatggatgaatatatttggttattattccgtgtatacgatgtctacttttttactgattcgtatctggcagggaaaagcagtcctggcagcagtgattcttccattgttgttttactatctgctttgtgcttataaaaatgagtatcaaattcaggatattatccagatttttctgacgacaggagcagcagcgctgacctcttccatgggaattttcttagcaccgattatggtggcgcttggggcatttgcgggaattatacagacaagaaaaataggaatagcatggaaattgctggctggatgtattccttgtatcatactgacaggaatttatctgctgttaagagttgagggaatgggatgagtagtgaagtatttgatttgattaaatttttctggaagcattataatggaaagggattttacctgtatctctttttaggcggtatggttctgcttttgtttttaagagagagaaggaaatataaccgttatttgttttggtactgtattggtggactgattttgtactggattccgtatacggcaaaaattattatggactatgcaattggaaagacggtttactggagaatgttctggctgcttccgattacgtttgtgattgcttattttgctgtatcgtgtatctcacagttaaagaacagactttttgcagtggtactggcagtgctgatgctgtccggacttgcctttagtggtcggctggtttacaacaaagatgtatttcataaatcaaccaattattataaactgccacagaccgtgcttggtgtgtgtgatgcaatgaaaaaaaatgccgatggagaggaaattcgggcaattgttccggatgagctgatttcttatgtcagacagtatgacccgtcgattcacctgatttatggacgcgatgcaggcaaggattcaagaaccgataccatggaagctgcgattgtgtatgatgtgattaataatgaagaacaggataaagagacctttcgggaagcgcttgctctttccggctgtaattatcttgtactttcagaagagcataccatggactggtatgcggaagaagaatacgaaaaaatcgcaaaaattgatgagtattgtatttatagaattgacaaatagcaagtaagagatgtctgtatctttttgggtacaggcattttttaatcctttcgattgaaattcataagagaaaatggtatattgtaaaggttaagtatactttaccataagtagaggagattagaatgaacatatttagagaattgtggagaaacaagaccctggtgtggaaactgggtaaaaatgacttcaaaacaaagtatgcaggttcttattttgggattttatgggcctttgtacagcctatggttacaattttgatttacatttttattttccagtttggatttcgcgttatggatacgccaaacggatatccgtatgcgctgtggctgattgcaggtattattccctggtttttcttttcagagggaattatcaatgcaaccaactgtttgatggaatatagttatctggtaaagaaagtcgtatttaaaatcagtgtacttccgcttgtaaaaattttatcggcattgtttgtgcacctgttttttattgcatttgcgatttttatctatattattatgggaaagacaccgattgttcagatggctcagcttggctactatacaatctgcgcaatctgtctgatcactgcgattgcctattttacctgttccatcgtaccgtttttcagagattttggaacgattatcaatatcctgatgcaggttggtatgtgggcatgcccgattatgtgggatatgtcaacgtttaaaatgcctgcaaaagttgaatttcttttaaaattaaatccgctgtattatgttgtacagggatatcgtgacagtttcatggatggaatctggttctttgagagaccaaagatgacgatttacttctgggttgtaactttaattatcggagtgattggatttactgtattccgtagattaagagtacatttctcagatgtattgtaggagggacacatggacgatattgtagtatcaattaaagatgtcagtaaagtatacaaattatatgataaaccgatagacaggctgaaagaatccctgtctattacgcataagagctatcatcaggaccattttgccttagagggaatttcacttgatgtgcataagggagaatgtgttggaattatcggaacaaacggttccggaaaatctacgctgttaaagattattaccggtgtattaagtccgacaaccggaagtgttaccgtcaatgggaaaatcagtgcgcttcttgaattgggtgccggctttaatatggaatatacgggaattgaaaatatttatctgaatggtaccatgcttgggttttcaagagaagagatgacagcaaaacttgatgatattattaattttgcagagattggcgattttatcaatcagccatgtaagacttattcgagtggtatgtttgcccgccttgcatttgcggttgctatcaatgtagagccggatattttgattgtcgatgaagcattgagcgttggagatattttcttccagtcgaaatgttaccgtaaattcaatgaatttaaagaagcaggaaaaacaattatttttgttacgcatgatatgggaagtgttatcaaatactgtgaaagaagtatgctgattcatcacggacatcatgtactgaccggaacgtccgcagaagcagtggatgtatataagaaaatccttgcaaatcaatatgatgacagtgcaaaggacgaagaacaggaagaaactacagaggtagaaactcaggaaacagaaacgaaagaaaaacaggaagcaaaaggctggaagagtaaattaactttaaacagcaatctggattcttatggaagtctggatgcagagattgtggattttgcaattgtgaatgataagggagaaatcagttcttccgtagataaaaataaacagttccgtattaagatgaagattcagtttaaaaaagatgtggaccatccaatttttgcttatacgattaaagacagaaaaggtacggaaattacaggtaccaataccatgttggaaaattatacaccggcacactgtaaggcaggggagatcgttaccgttaattttgaccagattatgacgcttcagccagggcagtattttctttcttttggttgtaccggttataatggggatgatttggagatttatcacagactttataatgcctgtcaccttgaagtcttttcaaagaaagagggaacgcttggtttctttgatttgaattcaacggtttcttatgacggggcaatacaaacgaaataataaataatagaaggattatatgggatgaacgaaaagattgggaaagttacattaaatctggactattatgaaggtcaggatttttacagtgacggtgtgattgaagagcatctgttagagctggtgaaacatcacgaacctgaagagtatcaggatattatcttaaaagaaaaaaactgggctgtgatgtatcatctttcacagcaaagagagaatattttagagtggtatccgataacaaaggaagattccgtgcttgaaatcggagccggatgtggtgcaatctctggtgtgcttgcaaaaaaagccggacgggttgtggcaaatgacctgtctaagatgagaagttcaattaatgcatggaagaataaagaggcagaaaatctggagattgtagtcggaaactttaatacggtatctgataatctgacagaaacctttgattatgttaccttgattggcgtgtttgagtatgcaaagacttatattcaggaagaagagccatatcgggtatttttagataaaatcaaccgtcatttaaaaccgaatggaaagattttgatggcaattgaaaataagctgggactaaaatactttgcaggctgtaaagaagaccatgtcggtcggatgtttgaaggaattgaaggctataaaaatacatccggagtagagacattcagcaaaagagaattagagaaactgctcgatgcaaatggctatcacaattatcggttctattatccttatccggattataaatttgcaacaaccatttattcagattcttatcttccaaaaaaaggagaactgcggaataaccgccgaaattttgatgcagagcgtctgttactttttgatgagggacttgcctttgataccatgattcgtgctgaattattcccgcatttttccaattccttttttgtagaaattcagaaaaaggaggaaaacaatgcctgagatattatattcaaaattttcaaaagaccgtcagaaaaaatttcagattgcaacgatgattgtagaagaaaatggagaaaaatcggtcataaaaaaagcgatgcataaagagggagaagcccatgtaagaaagatggtcgaatcccgagaactgctttcggaattatttgtaaattcaggtgtggaaatgtgtccatgcaaagaggaaaatggtcaggtccgttttttatttgtggagggggaaagcttagaagaaagaatccaccgccattcagaagcaaatgactatgaagccttgaaagaggattatcgttttcttgcaaagattattttttccgtaaaaggaatgcatacattcgagagcagtccggcatttgaagaaatttttggctttccaaagtttaaagaagcgcaacattcggcagatatttccaatgttgatatgattccggcaaatcttctgtttggtaaaaaatgtgtgctggcagattatgaatgggtctttttctttgagatcccattagaatttatctatgcaagaagcattttcttgcaggaagcagtctgcggtttagataagagtcagttagaagaactctatgcaattggtcgtgtagatatggaagaagtgccggtttattatcaaatggaagtgaacttccaggaatatgtggctggaaaaggcgaaaaatatgccctgtcccatctgtaccagaaaatgcactgtaaatcttatcctgtcagtgaatgggattataagaaacagttcttttctatcggtatcgagggagataccggtgaagaatgggaagaaatcagctacgagcagaccattcattctgagattaagagaacgattcaattaaaagcaaaccaatataccagacttcggttcaaaccggtggattctaaaagtattataaaaatcaggaaactggtcggaaagaaagaaaaacaggaagttagtttgaattttactcataatgcaaaactggtgattattgatgattattatttcatagaaccaccggtacttgaaatcgcacttgatggatgtgaagaaatcgaatttgattatttggtttatcgcagaaatgatggtgtcattgatcagatggtgacatttattcagaatgagaaagcgttaaaagatgagagacagatgctgactgaaaaaaatgcagcacacgaagccaggatagccaaacttggaaaagagttaaatgacttacaggcgaccgtagaatatcaggcagaaaaaatccgacagcttgaaaatttaaaagtctataagatgtatcaaaaagtacgtaaaatagtgaaaaggggtaattgatgtatggacgtatccattgtaattcctactaagaatgcaggtcctttatttgaaaaagtgctggatatgatattttcccagaaaaccatttatgaatatgaggttatctgtgtggattccggttcaaaagatcagacacttgaggtaattaaaaaatatccgtgcaaattatatcagattccggcatcagaatttggacatggaaaaaccagaaattacggggcttctaagggaacaggaacttatattgtatttattacacaggatgcacttcctgcaacggacacctggcttcagaattttattgatgccatgaaaaaagacccggaagtggtgggtggatttggaatccattatccttatccaggctgtaattttatagataagagagatattgaaggattatttcagggatttggttctgataatacgattttttatatggaagataaggaacgctatgaaagagaagaaggatatcgacatgtacttgctttcttctcagataataattcctgtgtcagaagagatgtatttgaacagcatccttatgatgatgttaattttgcagaggatcagatttgggcgagaaagatgatcgagttgggttataaaaaagtatactgcccgtttgcaccggtttatcattctcacaactttaaattaagtacttactttgcaagatattatgatgaatataaaggtctctatgaaattcatcagtatatgatggcacagcattttcgccagctcccacgtctttgggtgcgtcaggtcagaggagactgtgcttacatccgtcaacagccgatcggaaagaaaacaaaaatcaaatgggctatttactccgcatttcgtaatttcgaccgttttgtcggggggacacttggcggaaagtaccatacttattcggaagcaaaacagaaatttctggacaaacatatttcacagcagtacagacaaagaaaggcttaactggtcttaggtgagaaaggaaaaaagaatgagcgataatgtagtagaaagaggaatgagatatttaaagaataatggcgtgaaagcaacattaaaacgtatgaaaaacggacctgcaccgattccgccaaagaacaatctgcttggattttataattttgtagtcaatacagaagaaattccatttgataaaaaggcgtatgaagaggcaaagaaatctggaaaaatcacattaaactgggtcattccggaaatgagtccgggttcaggcggacataccacaatttttcgttttgtatcaaatttggaaaaattaggttttcacagcaaaatttatctgtatatgtctccgacatttaaagataatgagtccatccgcagtttcttaaaacagcacttcccactgttagatgagagagtagaagtttactgtgatgtgtcacagatgggatttgcacacggcacagttgcaacagcatggaccactgcttactatgtcagaagatttaataataccatttctaaattttattttgtacaggactttgaaccatatttttatgcacatggttcagaatatgagtttgcagaaaatacttataaaatgggatttcgtggaattactgccggtgactggttaaaagatgtaatgagaaacgattatggcatgacagcagatagtttcttattctcttacgatgacaagatttacaaaccaaaagaaaaaacagatgacaaaccgagagtattcttctatgcaagaccggttactccaagacgtgactttgagcttggtatgctggcaatcaatgaattatggaagaaaatgccggacttagaggttatttttgcaggatgggatgtcagcaactatgaaattccattcccacatcagaatcttggaactgtaacaccacaggtacttgcagattcttatgtaaaatgtgatatgtgtctgattatttcaaacacaaacctgtccctgctgccacttgaagttatggcttgtaactctgttgcagtctgctcgaaaggagaaaacagcacctggcttgtcaatgaagaaaattctatcttagtagattatgacccgaatcagattgcagatacaatggaagattacttcaaacacccggaaaaattagcttcaatccgtaaaaaaggtctggaatttgcaaaaaatacttcatgggaaagagaagcagaaaaagtaaaagaggcaattcttagaggaattcatgaagatgagcagaaaattcaaaaataaacagaaacttggacggacagtctgcatgatttttgccctgcttctggtatttggaatttatctggcatgggcctgcagtcagaggcataatttttcacccgatgaagggatgcgttcccgaatcgtgcagtatatctatgagcatggaaaactgccgcacggtggagaccccgagataagagatgaagattggggaatttcgtatgcgtttaatccgattttaagttacatgatttctgcgttgtttatgaagattacttcatttttcacgacagatgagtgggcactgttgatttctgcaagaatggttaatgttctattcggaacagcgtcagcgtattgtatttttaaaatcggagaagcattattcaaaaaaggagaaagggtgatgttctttttcctttgtaccctgcttcccggtgctgcaattttatatacttatatcaattgtgacggacttgccttattttcctcatcgtttattatttatatgtgggtgagggcaatgaatgagggctggacaaagaagaacagtattctgcttggaattgcattatcactttgtgcgctttcctattatgatgcttatggttatgcactgtgcagtattttattctttgtcgtttcctcccttggttatggcaaaaagaaaccggattttaaattaatgttcaaaagaggtctgttaatcacggcagttgtggcagtgcttgccggatggtggtttgtaagaaactatatcatctatgatggagattttcttgcaagaaaaaccatgcatgagtatgcaatcaaatatgcaaagccacagtttaatccccaaaatgtaacgacatttaaggattatccggaggcaaacattatctcgatgttaaaatatcatgctcccggttttaagtaccgctggattggaatggtagtctatggggtagttggaatctttggatacaatcagatctttcttggaaaaaaagtgtattatccatattttgcattgattcttgtcgggctggtatttgtaatctggaaagcaagagatattttctatttaaaacgagagcaggttatgcttgagaagaaaatcaatgaagaagaaaccgtagaacaggtattaatccgtcagaaaggaatccgtccgcagggattattccatctgtgtcttttacttggaatgataattccgaatgttttgaacttatattattcttatacttcagattatcagccacagggacgctacagcatgccgatgttagttccgatgatgtattttgtaacgatgggatattcgagagtcgcagaccattttattaaaaatcagaaattaaaacagctttgttattatctggtttcagcaggaacaattgtagttgcactgtttttatgggcaagactgttgtacccattatatcttcagaactataatggtctgcattaatggatttccggaatttttcaacagacagattctgggagtgcatgattagtcataaggaggaataagatgccaaattggaacaatctcacgtcaaaggtaattcagacggtagaagcagacggaattttgggacttggaaaacgcggtggcagatatttaaaaaaaaggttcggagctttagcaaaaaaagagtccgaaccggtttttaaagatgtgctgtttattgatggatgtggaacagtactgccacatccgtcaagatatcgtgtcagccatcaaagagaacagcttttatcttatggaattacatcagaccaggtgtactttgcagatttggatttaaaacagattggctggtataatgtgtttgtattttttcgctgtccactcaatgagacaacggaaaaatttgtaaaattagcaaaaaagtatcaaaaaacagttttatatgatattgatgaccttgtatttgatataaaatacacagatacgattccttatgtaactgcgcttgaaaaaaaagaaagagaagcctatgatgagaatgttcgggcgtatggacagctccttgacttatgtcagggggctgttaccactacaggggaattatcagaagcattgaagctgcatgtaaaagaggtctgcatcaatcgaaacagggcttctgaggaaatgatgcagatttccgaaacagcattaaatcaaaaaacagaacataaagaagttgtacgtttaggttattttagtggaagcattacgcataatccagacattgaaatgctgctgccggtgctcttaaagttaatgagacaatataagaatctggaatttgtcagtgtgggagagctggaaattccggaagaattaaaagaatttgcagaccgaatcaagattcttccgtttgtggactggaaaaatcttccgaaattgatttcagatgtagatattaatttagctccactcgaagatacgatttttaaccgcgcaaaatcagaaaataaatgggtggaagcttcccttgttcaggtggtaacggtggcgtcgaatctgggtgcatttgccgatacgattgaaaatcaaaaaaccggatttttatgcaaggatttaaaagaatgggaagaaacgctgtgcgctttgattgaacagccaaaacttcgcagaaaaactgcgatgcaggcatatcagttttgtaaagaagcctatcttacaacctatacaggaaagacactggtggattttatcaaagccaaacggaccaaaaatgttggaatcctgcttccggcacttaatatcagcggtggaatcatggtggcaatgtggcatgccgttttcttaagggaggctggatttgatgtcacgattctttcagaaaatacaacggaaacttcatgtgtctttgaaaatcagaattttccggtgatcccattaagagaggatgcagtcagcggtcactttgataagatgattgcaacgatgtgggtcacagtaaaatggctggaattattttcgaatattgataaaaaatattatctggtgcagaattatgagacggatttttatgaaaaaggcagtccatatcgtgcaatggcaaacgccacctattgcaaaaaccagattcagtatgttacgatatcaaagtggtgtaaggaatggttaaaagaacggtttgaaaaggaatgtgcttatgcaccaaatgggttggacactcgggtttttactccatgtgctcgtgattttagcggaaaaatccgaattttaatcgagggagactgcggtgcatggcataaaaatgtagatgaaagttttcagattgtagagaaactcgatagagagaaatttgaaatctggtatctttcctacaattcagagccaaaagaatggtacaagccggaccgttttcttcataaagttccatttcaaaaagtgtcagaagtatacaaacagtgccatattctggtaaaatcaagcatactggagagcttttcctatcctccgcttgagatgatggcaaccggaggtcttgtagttgtccgtccaaatagtggaaacaaagaatatttaagagatggggaaaactgtctgttatatgagcctgaaaatatttctgaggcagtggaaaagattatggaattggcagaaaatgagacacttcggaaacatctgacagagggcggacttaagactgcaaggcaaagagaatgggaaactgtaaaacagcagattttaaatctgtatctggaagcaggagaataaaatgatgaaagcaaaaaacttaataaaacgagtaacgattggcattttggcagttgtgcttagcacttctgttgtgtgggcggacgataatccagggctgattcaaagggcaaaagatgcctgtaaaaatgcaacctatgatatcccgacagtgacaaatgacattgacggctggccacaaggactggcaattatgtgtgattcagctgttgtgatggaagctgaaagtggagaagtgctttataataaagcaatggatgaacgccgttatccggcaagtacgacaaagattatgacggcactggtcgcactggaacattctaatctgactgatacggtcacctttacagcagaaggtttaaaagaagctgttcctggaaacagttatgtgactccggtcattcaggaaggtgagacactcaccatggaacaatgtctgtatgcgattatgcttgtctcaggaaatgaagtttcgacacaggtggcaatgcaggttggcggaagcgtagaaggctttgtggaaatgatgaatgagaaagcccaggaaatcggatgtaaagatacacattttgtcaatgcgaacggacttcatgatgaaaaccattatacaaccgcgcacgatttggcgatgattgcacaggaagcttacaaaaacgaagaatttcgcaaaattgtaggaagtcgttattatacgattccggcaacgaataagactgccgaggagcgtgtacttgcaaaccatcatgcgttgcttggagagggtgactggcattatgacggctgtcttggaggaaagaccggttataccgacaccgctttaaatacgttagtcacttattttgaaaaagacggaaccgtttatatttgtgtggttttacattacaaaggcacagaagtttttaccgatacagttatgcttgcagaatataccaaagaattcgaaaaactgcaggtatcaccaaaaaaatatacactctcaggcggaaccgcagttgtgccaaaaggaacaacaacggatgcgcttgagatacagagtacacaaaacgaagatggaaacgaacaggaaacctttttatttaatggatatgaagtcggtcaggcagttgtagatacgaaagcttatgaggcagataaaaaagctgaagaagcacagaaggaagaagagtcaaaagaagagcagagccagaataacgaggcacaaagcggttcttttagtacatttgaaattgcagtggttgtgcttgtaggtttgattggacttggactgattttaatcgtgatttctgtgataaaaaagaaaaaaaagaaatgataagcaggtgagaagatggcaaaaggaaaaattgaatggggcagaatgttagggaaactttctccttataccattctaaaagggcttcgctatatgaagcattatggtccgaaagaattctggattcggcttcatgaaagatttgaacccgaagaagtcccttatggtccatggtatgaggaatataaggtgaaaccggaagaactggaaaaacagaaaaagaaaaaatggaactacgaaccgaaaatcagtgtagttgttcctgcttataagacaccggagaaatttttaagagagatgatagattctctgcttgcgcaaagctatgcgaactgggagctttgtattgcaaatgcaagtccagatgaagcagggatgagccagattttggaagaatactgcaaaaaagatgccagaatctgtgtcaaaccgcttcttaacaatgcaggaattgcagaaaacaccaatgaagcattgaagatggcaacaggagattttatcggtttgttagatcatgatgacctgcttgcaccaaatgcactgtatgaagttgcaaaagcattagagagtcatccgaagactgatgtgatttatacggatgaggataaggtaagagcagatttatcggaacatttccagccgaatttaaaaccagattttaaccttgatttgcttcgttctaataattatatttgccatttctttgtggtgcgccggacaattgtggaaacaattggtggattcaggaaagaatatgacggagcacaggattatgattttattttccgctgttgtgaaagtgcgaaagagatttatcatgtgccggaaatcttatatcactggagaacgcatcaggcatcgacagcagacaatccggcaagtaagatgtatgcgtttgaagccggaaaacgtgcaattgaaggtaatttagaaagatgtcatttaaaagcagaagtcagtcataccaaagaccttggtttttaccgtgttaaatacgaggtggaaggtacaccgcttatctcgattattattccaaataaggatgaaagagagtccttaaaaaaatgcattgattcgatagagaaaaaatcgacttatgaaaattatgaaattttaattgtagaaaacaacagtacttcaaaagaaatctttgagtactataaagaattaagtgataatcctaaaattcgcctgttaaaatggaaagagggatttaactattctgcaattaataactttgcggcaaagaaggcaaaaggtgagtatcttttgttcttaaataacgatatggaagtgattgcatcggactggatggaagaactgcttggacactgtcagagagagggaacaggggcagttggggcaagactctattatccaaatgagacgattcagcatgccggcacgattatcggaattggcggaattgccggtcatatgtttgttgatatgccgggagaacgtaccggatatatgcataaggcagcgattcagcaggatttaagtgcagtgacagcagcctgtatgatggtaaagagaagcgtatttgaagcagtaaacggatttgaagagaaactttcagttgcctttaatgatgtggatttgtgtctcagaattcgtgcacagggcgaattaatcgtatatgacccttacgtggaactgtatcattatgaatcaaagagcaggggaacagaggacagtaaagaaaaagtcagaagatttcaggaagaaattgagtttatgcgctgtcgctgggagaaactgttaaaagccggagacccgtattacaataagcatttttcactgacaaagtggaattattctttaaagccatttgagtaaggggaacaggtatgcaggatgtatcagtgattattccgaattttaacggaaaaaagtatttaaaagagtgcctggactcgttaagaaaacaggattatttgtattttgaagtgattttggtcgataatggctcagaagatggaagtgtggaatggacaaaggaaaattatccggaggtacgtgtgattgcgctcaaagaaaataccggtttttgtggcggagtcaatgcaggaatccgtgagtcaaaatcagaatatgtattgttattaaataacgatacgattgtatttccggaatttattacagaactggttcatgcaatcgaacgggcaccggatatcttttcatgtcaggcgaaaatgcttcagattcaggatgaaaacaagatggatgacgcaggaaatttttactgcgcacttggatgggcatttgccgatggaaagggaaaaccggagtcagagtacaataagaccagagaaatttttgcttcctgtgcgggagctgcgatttatcgtaaagaaattttagatgaaattggctattttgatgaggaacattttgcctatcttgaggatgttgatatcggatatcgtgctaaactgcatggatatcgaaatctgttttgtccgactgcgagagtactgcatgttggaagcggaacaagtggatcgagatataatttatttaaaattcgatattcttcaagaaacaatctgtatttgatttataaaaatatgcctctttggcagattattttaaatttcccgcttttgtttgtgggatttacaataaaaacagtcttttttgcaagcaaaggttttggaaaagattacatcaaaggaatgtggaatggaattgtaatctcgaaagagaacaaggaaaagaaagtaagaaatgtagcacatcagagggaacggtgttggaagatacagctggaattatataaaaacataggaaaacgctttcgttctgaaaagagaaagtaagatactttcgaaattttacagaaagatttcgaaagtacataatagacatagaaagaagtatagagaggaaacaatgaagatacaggtaggaaaaaaagagctttccgagaagcagaaaaaaattttaagaaaagtaaaagtgattttgcaatatgtttttatcttcctgtcgctgttaattgcaacaacggttgcctgggtatttcgcacctggaagggccttacaatggaagaggtggtattccacattcaggcaccgacaacaggaacagattcgggaattatttcgagttttattctaacgtgccctttgatttcgattgtgttaacgttagtaattttattgctacataaaagactgggaaaaataaaagatattgcggttttgggtttaatggtggcatttcttgcagtagcagcattttctgttggttatatgtggaatcggcttgacattaccgcttatgcaaaaaatcagacaacagaatctacgtttatcgaggataattatgcagacccaaaagaagtagagctgacttttccggagaaaaaacgaaatttgatttatatttatctggaatcgatggaagatacttatgcagataaaaaaagcggaggtgcatttgaaaagagccggattccggaactggcaaaattatcacttgaaaatgaaaatttttccggaaatagcacagccttaaatggtggaatcccaatgtacggggcaacctggactatgggggcattattcgcacaaacttctggtctgccgttaaatcttccgatccgaggagatttgatgagtacgcagtctgaatttcttccgggtgtaatcaatcttggagatatcttagaagagaacggatacaaacagtactttctgatggggtcagaggcagaatttgccggacgcgatttgtattataaacagcatggcaattatacgatttatgattataattacagtctcgaaaatggagaaattccagaagattatcacgtgttctggggctatgaagatgcgaaactgtttgaatttgcaaaacagcatttgacccaaatcagtaaaaataacgaaccatttaacttttcaatgttgacggtcgatacgcattttgaagatggatatcgttgtaaggactgtccgaatactttcggagatgaccagtatgcaaatgtaatggcatgctcaagtaaaaaagtaacggaatttgtaaaatggattcaagaacaggatttctatgaaaatactacgattgtcatttcgggagaccatctgacaatggacagcaatttctgtgatgatgtgccgtcctcttatgaacgaaaagtctatactacttatatcaattccgcagtacaaccggagacagaagactatagagaatattccacaatggataactttccgacaacccttgcaagccttggcgtagagatttcgggaaatcgtttagggcttggtacaaatttattttcaagcgaagagacattaattgaaacatatggaaaagagcaagttaataccggattgaaaatgaaatccaaatttatggatgagctaacaaaagatattgtagtggaaaacgccaaaaaagtgcaggaagaagaaaaggcagaagcagaggagaaaaaaattactgcagatatcacggtttcagattatgatgcactgagtgattcgtttaaagtaagcttaagtaaggtaaaatgccagctcccggtggaatccatccaatgtacagtatggaaatccgatggcatgaaagcccttgtatggtatgaagccgaaaaacaagaagatggtacttacagtatcgaagtaaagggcagtgaccttgcgcacgaagaaggcagttatgatgtcattgtctatggacaggcagaaggctatgatccatctgttattaaaactgttaccggcgaaatcaaagagccggagtctaagataacggcagatgtgacagtaacaaactatgatttcagaaaaggttactttgatgtcattttaagtaatgtagaaagtacagagccggttactgcaattgaatgtacggtttgggaaaaggatggtactgtggcattaaaaacctatcaggcgaaacgtcagggtgatggaacctatctgcttcgaatcaaggcgatggacttctattataagacaggaacctatcgaattttgatttacggtcagactgaaaattcaccgatgatgcagatggatgaagtgtttggagagattacaggataaaaacaagagaataaataaaaaaaggcgaatgaccgaaacgtcattcgcctttaaaattttcaagattagaaattagaatttaaaagtatccttaagtccgagccatttctggtctttgtcgcttaagtttaacgcagtgccatcttctaagacatagccttcagaagatgcagtgccattataagtaccgattaattttggccatttgataccgattttcgggtcgttccatgcaagaccgccttcatctcccggatgatagaaatcagtacatttgtagcagaattctgcaatgtcacttaatacaagaaatccgtgtgcaaagccttccggaatataaaactgttttttgttctcttcggtcagttccacaccaaaccattttccataagtcttgctgtcacttcttaaatcaacggcaacatcaaagacagagccttttaccacacgcaccagtttgccctgtggaaattctttctggaaatgaagtccacgtaagactcccttggtagaactggactgattgtcctgtacaaaattcatggtaagtccggcttctatcatatctttctgattgtaggtttccatgaaatatcctctggcatctccatgtacagtcggttcgattacacagagtccttcgataccacctgcatttttttcaactttaatctgtcccattttatttactcctgtgtttttaaatccttaagataacggtttaatgcatcctgccaggttggtaagagtgcaaaaccatttgcggttaatttgctcttgtcaagacggctgttaaacggtcttgctgccttggaaataccatattcggcagttgtgacaggagctacggttaaatgttctttggaatactcctcctcgcccatgatttcataagcctgacggaagatttctgtggcaaaatcataccagctgatgtaaccgccctcattggttgcatgatagtaaccgtatttttctgtttcaatcatatcaactaagagtctggcaaggtcaaaggtataagtcggtgtaccaatctggtcatttactacggttaatttatcatgattttttccaactttgagcatggttttaataaagttatttccgtttaaaccaaatacccatgcaattcttacgatgaagtatttggaaagcgtttccgatactgcaagttctccggcaagtttactctttccatagacatttaacggtttgtagtctttgcagtccggtttccatggagtttctccctgaccgtcaaagacatagtctgttgaaatatacatcattttgataccaagttctttgcagacattggcaatattttgtgtgccagtgccatttacaagcatgactttttcctgatttgcttcatcttcagcggcgtcaaccgcagtccatgcggcacagtgaatcactgcatccggagctgcttctttgataacctggttgacagaagcagagtctgtgatatccatttcttcgatatcaacaccgattggagtatgacctctttttttgagttcatttacggtatcgtatccaagctggccttttacacctgttactaaaactttcatggaaggtttcctcctttaataattagcggtttccgtacattttttcatagtagttctgatattcaccggaaatgatattttcccaccattctttgttatctaaataccactggattgttttcttgattccatctgcaaacttggtttccggaagccatcccagttcattgtgaatcttggtcgggtcgattgcgtagcgcatgtcatgtccttttctgtctgtgacataagtaatcaggctttctggttttccaagttctttacagataatttttacaatatcaatgtttttcatttcattgtgaccgccgatgttgtaaacttcaccgacacgtccattgtgaatgattaaatcgattgctttacagtggtcttccacgtaaagccagtctcttacgttttcaccttttccgtaaacaggaagcggtttgtcatttaatgcatttgcaatcataagcggaatcagtttttcaggaaaatgatatggtccgtagttgttagaacaacggctgatggtaacaggaagtccgtaagttctgtggtatgcaagaaccaataagtctgcgcccgctttggaagaactgtaaggactgctggtgtgaatcggagtttcttctgtaaagaataagtctgggcggtcaagtggcaggtctccgtaaacttcatcggtagatacctgatggtaacgtttgattccatatttacggcaggcatccattaagacagcagtacctttgatgtttgtatcaaggaaaacttccggattttcgatagaacggtcaacatggctttcagcggcaaagtttacaaccatatccgggtgctcttcttcaaacagtttataaacggcttcacggtctgtgatgctttcttttacaaaacggaaatttgggttttccataacggattccagtgttgaaagatttccggcataagttaagcagtctaagcagacaatacgataatccgggtatttgtctaacatatgaaaaataaagttacttccaataaatccggcaccgccggttacaataattgtcataatttaaaattctccttttcgtgatgcgaataatggttagtgtaaaacgtctaaatattttccatcgagtacgtcttttaagtattgtccgtactggtttttctttaagacttcatacactttaagaacctcttctttggtaatccagccatttaagtaagcgatttcttcaaggcaggcaatctttctgtgctggtgggattccatggtttttacaaagttggttgcctcaaccagactttcgtgtgtaccggtgtcaagccaggtaaatccctgtcctaataattcaacatttaagttgccgttttccagataaatacggtttaagtcagtgatttcaagctcaccacgtgcacttggttttaagttctttgcatattcgactactttgttgtcatagaaataaagtcctgtgacacagtaattgctctttggatgttccggtttttcttcgatagaaacagctttgccttcgtgattaaattcaacaataccgaaacgttccgggtcatcaacatagtatccaaataccgttgcaccctttccggattctgcattttcaacggcggcttttaagcgttttttcagaccgtgacctgcaaaaatgttgtctccaagcaccattgcgacagtgtcatctttgataaagtcctcaccgataataaaagcctgtgccagtccatccgggcttggctgtacggcataagacagatgcactccaaattgatgtccgtcgcctaagagttccttaaaacgaggagtatcctgcggagtagaaataattaagatatcacggatgccggcattcatcagtacggacatcggatagtaaatcatcggtttgtcataaattggcaacagctgtttggaagttaccatagttaaaggatagaggcgggttccggaaccaccggctaaaataattcccttcatgtgaaaatctcctttcttaaaagaggtagtgtaatgttacttttttgtctcgtagtttctgataatactattataaaagatgacgtaaggtcaccttcaagcgtttttttaaaaagtacataaaaaaattccggcgtcttttgtaatgtgaaatccatgggcggtttttttctcgacaaagctgcgaaactcatggtaacgttccaataacatctggttttgatttccatgacaggaaagaatgtactcaattaaaggttcggcacggtcaagctcaatcgaatcttcatatcggatacactgaacgtcagaaaagtaaggctttaaaagtgcttctccattttcaagcccgaactgttcatataatttttccgcagataagacaatccggctgtcaaattcctgaacaagttcactgatttcaatcatgtggcgctttccataggtactgcagagaaaatggccgcctttttttaatgatctttgaatctgcttaaaaacttttggtaaatcattgcagtaaaacaggacatggtttgcgataattaaatcaaaggcagaaagcgaagacggaaaagaatgacagtcaaaacaggcaaaggaaaaccgcttatcaccggacggcaggtttcttctggcatctcgtaacattccgtccgaaacatccgataataaaatagagaggttcgatgggatatgattcagattttccgtccataatgctccatttccacagccaatttcaagtacccgctcattgggctttaaattgcaatgttcaaaaatccacggaaaccagccttttgaattggtagaatattccttgtgcagacgaattcggctggaaatattggaagcattctgatattgagatttgagacttttttccatatttgttaaatgaatcaggtcaagcatctggctccagtcaatttggtgttcctgttcaatcactcggacggtatcttcgattgcactttctacaagctgcatctgttcaatctggtcctggattaatttcttttgaagattaagggagtttaacagaaagagataatcagaatcgtcgatggtcatttcacgaatatcgtcgagggaaaatccaagatattttaacagtagaatctgctggagacgggcaaaatcagagtccgtatagaaacgtgcaccggctggtgtcacataagaaggttttaaaatgttttgtttatcatagaatcgaatcgtgcgtacagagacatttgccatgcgggcaaactgccctgaagaataataacctggcagtttcataagaaaagtcctccataaaaaatataagaaatccaagataatggaacgataatcctgcaattccaaaaaatcctaaaaaagaataaaaaaaggatgcaggagatgggacttgaacccacacgatattgctaccacaggcacctgaagcctgcgcgtctgccaattccgccactcctgcatctgttattaagttatgttctcgcgaacacaagcaatactatacaatagtatgttgaaaatgtcaatacttttttggaaaattcctgcaattcataaaaataaattcctgcaatccgtaagtaaaaataaaaaagaataaaaaaaggatgcaggagatgggacttgaacccacacgatattgctaccacaggcacctgaagcctgcgcgtctgccaattccgccactcctgcatctgttattaagtttgcgcttttgtaagcacaaggaatactatacaataatatgtaaaaaaagtcaagactattttgaaaaaaataatcgaaaaagataaaaagagatgtggtataatataaagtaatctcagaatatttacggagcttatctttgtggctgattgtctgagggaacaggaaaaagtgagcagaagataaaaaattttaaaactgtaaaaaatatagaaaaaaaggttgaaaaatgaaatatcttgtgatacactttttacaatttggggaaaaataggaaacccgtaaactaacagcaagaaataggaaagggagacaggtgaaaaaatgaaagcatttttgatactggaagacggcaccgtctttaccggcaccagcattgggtcgaaaaaagaaattattagtgagatagtctttaatacatctatgacaggttatcttgaagtccttacggacccttcttatgccggacaggctgtctgcatgacatatccgttaattggtaactatggcatctgccacgaagaccaggagtctttgagaccgtggccagatggttacatcgtcagagaattatcacgaattccaagtaatttccgctgtgaagatacagttcaaaactttcttaagaagtatgatattccgggaattgccggaatcgacacaagagcactgacaaaaatcttaagagaaaaaggtaccatgaatggtatgattacaacgaatgaaaactacaatctggatgagattattccgaaattaaaagaatatacaacaggaaaagtagttgagcgggttacctgcgaagaaaaacatgttttaaaaggaaatggtccaaaagttgcattgcttgactttggtgcaaaagaaaacattgcaaaatccttaaatgagagaggatgcgaagtgacaatttatcctgcagcaacaccggcggaagaaatcttaaagagcaatccggacggaattatgctctcaaacggacctggagacccgaaagaatgtgtttccattataaaagaagtaaagaaactttatgattcagaagttccgatttttgcaatctgccttggacatcagttaatggcattagcaacaggtgcagataccaagaagatgaaatacggacacagaggaggaaatcatccggtaaaagatttggaaaccggaagagtttatatttcttctcagaaccatggttatatggtagatacagataccttagaccaaaatgtggcagtgccggcatttgaaaatgtaaatgataagacaaacgaaggattgaaatatatcggaaagaatatttttaccgtacagttccatccggaagcatgcccgggaccacaggattcaggatacttatttgacagatttatgaagatgatggaggaaagcaaataatgccgaagattcaggatattaaaaaagtacttgtaatcggctccggtccgattgtaatcggacaggcagcagagtttgactatgcgggaacacaggcttgccgttccttgaaagaagaaggaattgaagttgtactcttaaactccaatccggcaaccatcatgacagataaagatattgcagaccgcgtttatattgaaccgcttaccgttgaagtggtagagcagttaattatgaaagaaaaaccggacagtgtgcttccgactcttggtggacaggcaggattaaaccttgcaatggaacttgaagaaagaggattcttaaaagaacatcatgtacgtctgatcggtactacttcccagactataaaaaaagcagaagaccgtcaggaatttaaagataccatggaaaaaatcggagagccggttgcagcatctttagttgtacgtagtgtagaagcaggtattgagtttacgaataagatcggttatccggttgtacttcgtccggcttacacccttggtggaagcggtggtggtatcgcttataatgaagaacagttagtagaaattctggaaaatggtctgcgtctttctcgtgttggagaagttttagtagaacgttgtatcgcaggatggaaagaaattgaatacgaagtaatgcgtgacggtgcaggaaactgtattaccgtttgtaacatggaaaacattgatccggttggtgtccataccggagacagtatcgtagttgcaccatctcagactcttggtgacaaagagtatcagatgcttcgtacttctgcactcaatatcattacagaacttggaattacaggtggatgtaacgtacagtatgcattaaatccagacagctttgaatactgtgttatcgaagtaaacccgcgagtttcccgttcttctgcactggcttctaaagcaaccggttacccgattgcaaaagttgcagcaaagattgcacttggttatacacttgatgaaattccaaatgcaattacaggaaaaacttatgcaagtttcgagccaatgctggactactgtgttgtaaagattccgcgtctgccgttcgataaattcatcagtgcaaagagaactttaactacacagatgaaagcaaccggagaagttatgagcatctgcaataactttgaaggtgcattaatgaaagctatccgttctctggaacagcatgtagacagtcttatgtcttatgactttgcaagcttgacaaaagaagaattaatcgaagaattaaaaattgtcgatgatatgagaatctggagaattgcagaagcaatcagaaaaggcatttcttatgaagaaattcatgcaattacaaagattgacatctggttcatcgataaacttgcaattcttgtagaaatggaacaggcgttaagagaacaggaattaacagaagacttactgcgtgaggcaaagagaatcgaattcccggacaatgtcattgcacgtatcacagggaagacagaagatgaaatcaaagcattaagaaaagaatggaatatcaccgctgcttataagatggtagatacctgtgcagcagagtttgcagcagaaacaccatactactatgctgtatatggtggagaaaatgaagcggttggtgagacaacaaagaaaaaagtactggtacttggttccggaccaatccgtattggacagggtatcgagttcgatttctgttctgtacattgtacctgggcatttaagaaggaaaactatgaaactattattatcaacaacaatccggaaaccgtaagtacagactttgatattgcagataaactgtatttcgagccattaacaccggaagatgtagaaaatgtagtaaatgtcgaaaaaccggacggagcagtggttcagtttggtggacagacagcaatcaaattgacagaggccttgatgaagatgggcgttccgattcttggaacatctgcagaagatgtagatgcggcagaggaccgtgaactctttgataagattcttgaagagtgtcatattccaagaccgcaggggcatacagtatatacagcagaagaagcaaaacaggcagcacatgagctgggatatccggttttagttcgtccttcttatgtacttggcggtcagggtatgcagattgcaatcaacgatgaagacgtggaacagtatatcggaatcatcaatcgaattgcacaggaacacccgattctggttgataagtatcttcagggaaaagaaatcgaagtcgatgcaatctgtgatggacaggatattttgattcctggtatcatggaacatatcgagagagccggtatccattctggcgacagtatttctgtttatccggcacgtaccatctctgatactgcaaagaaaacaattgaagaatacaccagacggctggcaaaatctctgcacgttatcggtatgattaacattcagtttatcgtatgcggagaagatgtctatgtaatcgaggtaaatcctcgttccagccgtactgtaccgtatatcagcaaagtaaccggtattccgatcgtgccgcttgcaacaaagatgattcttggttacaaactgcgtgaccttggatatgaaccgggacttcagccggaagcaaaacacattgcaatcaagatgccggtattctcattcgagaaaattcgtggtgctgatatcagccttggaccggaaatgaaatctacaggtgagtgccttggtattgctcagtcctttaatgaagcactgtataaagcattcttaggtgccggaattaatcttccaaaacacaagaacatgattatcacagtaaaagatgaggacaaagaagaagtcattccgattgcacgtcgttttgaagctttaggatacaaaatttacgcaacaagaagtactgcaaaagtacttcaggaaaatggtgttcatgccgttcgtaccaataaaattgaacagccgtcaccaaaccttatggatctgattttaggacataaaattgacctggttattgatactccgtctcagggtgtagaaaaagcaaaagatggatttattatccgtcgaaatgcaattgaaaccggtgtcaatgtactgacttctcttgatacagcagaagctttagtaacaagtttggaaaatacagatattcagaaactggaactgattgatattgcgactgtaaaataaacagtgcagaattagaaagaaaaagcggattgtggaaaattggcaatccgcttttctgattttaaaggagacatcaatggattttattgaattactcaaggttatttttctgggaattgtcgagggaattaccgagtggcttccggtcagcagtaccggacatctgattttagtagaagaatttatcaaattaaatgtaagtgaagcattttgggaaatgttcatggttgttattcagcttggagcaatcatggcggtcgtagtattgtattttaaagagttatggccgttccagaatcagaaaaaggcaaagggtgcactggaacgctatgtaaaaaccgataaaatgattatgtggtttaaaatcgtagtttcctgtattccgtccatcgtaatcggtctgccgtttaatgattttattgaagcacattttaataactatctggttgtttcgattatgctgattgtctatggtatcttttttattctaatcgaaaattacaataagaagagaacggcttctatcaattctgttgtagaaatcggatggaagactgcatttttaattggagtattccagcttttagcagtcattcccggaacatcccgttccggggcaactatcatcggaggaattctgcttggaacttcaagaacagttgccgcagaatatactttcttccttgcaattccgaccatgtttggtgcaagcttattaaaactcgtaaaatttggtctgaatttcactggaacagaagccataattctgattgtcggaactttagtttcttttgtggtttcaattctggcaattaaattcctgatgggatatattaaaaaacatgactttaaagtattcgggtggtatcgaattgccctcggtattgtagtgttattattcttttcactctttcgataatcaatatttttctgattcatttaaggtttgttaagatagtttcttgtttttttataaaacggacataattttatcacaatttatctttataataggtttcagatagttgatgaaccactcactatctcccccctcaagtaaaaaaaccggtgcttgcgcatcggtttttttcattctacataaaactttgttccatatagattaaagtgatatcttgcttgcataaatggctaaagagaggtaaaatagaagtattaaaagcatcagagggaaaggggtacttattttatggcaaagaagaaagtagtagttgcattaggacacaaggcattaggtactacattaccggaacagaaaagtgcagtaaagaaaaccgctgcgattatcgcagatttagtagaagcaggtgcagagctggttatcactcacagtaacgcaccacaggttggtatgattcataccgcaatgaatgaatttggaaaggtacattcagactataccgcagttccaatgtctgtctgctcagcgatgagtcagggatatattggatatgatattcaaaatgcaatccgtgcagaactgcttcgacgtggtatttttaaaccggtcagcacaattattacacaggtcacagttgacccgtatgatgatgcgttccatgaaccggtgaaagtaattggacgagttttgacagaagaggaagcagaacttgaagaacagaaaggaaactatgtcacaaaagtagaaggcggttacagacgaattgtagcagctccgaaaccacaggacgtagtagaaattgatgcaatccgtacactctccgatgcaggtcagattgtaattgcctgtggaggcggtggaattccggtcttagaacagcaggcatctttaaatggagcaagtgcagtaattgaaaaagacctggttagtggaaaactggcagagctcttagatgctgaggaacttttaatccttacaagcgttgagaaagtttctttaaattatcagtcagataaagaagagaagattgaaaaaatggatgttgaaactgcaaagaaatatatgcaggaaaatcagtttggggcatctacaatgcttccaaaagttgaagcagctgtcagctttgtagagaaaaaagcaggaagaaaagcagtgattacctcgattgaccgggcaaaagacggtttccttggaaagaccggtacagttattgagtaaaactttttgcagtaaaaagaaaagaccatctccgaaggttaaaaaggggatggctttctttttgctatgtgacttgcttaagaagtacggtttatgttatcctatataccataccagaaataaaaatccttttgaaaggagagatagaaaatgatgaagctatcacaattattagaacagattgaatatacatgtgttcagggaggtctggacaaagaaatcaagagtgttgtttatgattcaagaaaagtgacaccggattctttatttttatgtattaaaggcgcagtgtctgatggacataaatatgcaaaagaagttgtagaaaaaggtgcgacagtacttgtcgttcaggatgaagtagaagtgccggaagaagttaccgttatccgtgtggaaaatacccgttatgcgatggcatgtatttcagcagcatggtttggacatccggccgaaaaaatgaaagtcatcggtattaccggaacaaaaggaaagacaaccactacttatctggtaaaatctattcttgaaaatgcgggatataaagtcggattaatcggtacaattgaggcaattatcggagatgaagtcattccggctgcgaacactactccggagtcttatattgtgcaggaatattttgcaaaaatggcagaggcaggctgtgactgtgttgtgatggaagtttcctcacagggtttgatgcttcacagaaccgcaggttttgtatttgattttggtatctttacaaatattgaaccggatcatatcggaccaaatgagcataaagattttgatgattatctgcattgcaaaggattgttatttaaacagtgtaaagttggaattgtaaatgccgatgatgaacatgtacagcaagtattggaaggacatacctgtacggtagaaacttatggtttgcatgacaatgcagatttatgggcaaaagatttaaaattagtgactggaaaaggtgtgcttggaattgactatgaagtacagggattgatggatttcccggttgaaatcgacttgcccggaaaatttagtgtctataattctttgacagcaatcgcaatttgccgtcattttggagtttccgaggagaatattcagaaagccttaagagctgcaaaagtaaaaggtcgtattgagatggtaaaggtatccgatgaatttacactgatgattgattatgctcataatgcgatgagtcttgaaagtcttttgacaacattaaaagaatataaaccaaaacgtctggtgtgcctctttggatgtggaggaaaccgttccaagttgcgccgttatgaaatgggcgaggtatccggaaaactggcggatttgactattattacttcagataatccaagaaatgaagagccacaggcaattatcgatgatatcaaaatcggaatcggaaagacagatggaaaatacgtggaaatcattgaccgtaaagaagcaattgcttatgcgattcacaatggacagccaggtgatgttattgtacttgccggtaaaggtcatgaggactatcaggaaattaaaggaaagaaatatccaatggatgagcgtgatttaattcgtgacatccttgcagggaaatagaatcagcagaaaatagatgaaaaaatggtatgcagatattattgtagatatttcacaggaaaaattggaccggacgtttcagtatgaaattccgcaaaatttacttggaatcataaaaacaggtacaaaagtagaagtaccgtttggaaaaggaagccgaaccatcagtggttatgtgattgggatttcagataagccgaagatagaagaaagcaaaatcaaacctgtttcaaagatatgggaaaaaggaattgaaattgaatcaaaattaatcggactggcaggatggatgagcagggagtacggctgtacgatgaatcaggcattaaaaaccgtacttccggtaaaagaaaaaaaacagcagaaggaaaccagaaccatttgccttaaaattgaaccggaagaagcgaaagcgctgttagaagaatgggaaagaaaacactataaggcaaaggcaaggctgttagaagcactgcttttaaaaggagtactttcttataccgaggcaacgggaaatttaaaactttccggtgccggaatcaaaaaaatagaagaaagtggtatcattcagattgaaaatcagaaagtatatcgtgatcctgtgcatcgaaaagaaacgaaaaccgttcaaaaacagttaaatgaagaacaagacagggcggtacttgagattttagaagagtgggaaagtccttttcatcgtccggttctgctttatggagtgacaggaagcggaaaaacagaagtttatatgaagctgatagaaacgatacttcgggaaggaaagcaggcaattgtactgattcctgagattgcactgacgtatcagacagtggagcgtttccgtgcctgctttggagagtgtgtgtcttttttacattcgagactttcagcaggagagcgttatgatcagatggagcgggcgaaaaatggagagatttcaattattgtaggacctcgttctgctttatttacaccatttccaaatcttggattaattgtaattgatgaagaacaggaatcctcttataagagtgagaaaactccgtgttatcacgcaagagagaccgcaatcgagagagccagacaagaaaaggcaaatgttgttatgggttcagcgacaccgacaatagagtcttacgaacgtgcaagaaaaggagagtatctgcttgttacattaaagtcccgctatcaaaatcaggtgatgcccgatgtgacgattgtaaatctggcagaggaattaaaggcgggaaaccgctctgtattcagtcagagtttacaggaaaagataaaagaacggcttgaaaagaagcagcaggtgatgctgtttttaaaccgaagaggttataccggatttgtgagttgtcgggcatgcgggcatgtaatgaaatgtccgcattgtgatgtgtccctgacgtctcacaggaatggaaaactgatttgtcattactgcggatatacgattccgaatgtaaaagaatgtccctcctgtggttcgccttatattggaggttttaaagcaggaacacagcagatagaagaacaggcgcatctgttctttccaaaagcgcggatccttcggatggatgccgatacgacaagaagaaaagacgaccatgagaagatcttatctgcgtttttggcacaggaagcagatattttaattggaacgcagatgattgtaaaaggtcatgattttccaaatgtaacgctggttggagtgattgcggcagatttgtctttaaacgtaggagattacagggcttccgagcgtacatttcagcttcttacacaggcagttgggcgtgcagggcgtggcagatttgcaggggaagctgtgattcagacgtatcagccggaacattatagtattgtgacttcggccagacaaaattatgaacagttttttgaacaggaaatcgtttatcgcagtttgatggggtatcctccggcaaaatcaatgctgacgatttcgggcagctcggcagaggaagccttgcttttggagggattaacctactgccgaaaatatattgaaagtatttataagaaaaatgatttattaatcgtaggaccggcaccgcagagtatttctaaaatacaagacatgtaccgtatggtactgcatctgcggcatggaaataaagaaatcttgattaaaattatggaaagactggaacgctatattcagattaataaaggatttgaaaagatttatatccagtttgatatgaattaattgaattgttgtacagcaaagtaattcgcaggcagtagagtaagagattgaatgaaaagaggagtaagaaagacatggcattaagacaaattagagtgcagggagataccattttagaaaaagaatgcagaaaagtagatgaggtaacaccaaaaatccgtgatttaatcgaagatatgatagagaccatgtatgacgcaaacggagttggtcttgctgcaccacaggtaggagtgttaaaacagattgttgtcattgataccagtgcagacggagaaggattgtatgtattaattaatccggaaattcttgaaacatctggcagtcagacaggagaagaaggttgtttaagtgtaccgggcatgtcaggtgtagtgacaagaccggactatgtaaaagtaaaagcttatgatgaaaatatggaagaatttattttagaaggaacagaacttttagccagagctatctgtcatgagacagaccatttacatggaaaactgtatacagaactggtggaaggggaactgcaccgtgtaaattacgaggaggaagaataggaatgaaagttgttttcatgggaacacctgattttgcagtcggaacattggaagagatcgtaaaagcaggacatgaggtggtggcagttgtcactcagccggacaaaccaaagggcagaggaaagactttaatgccgacgcctgtaaaagaagctgcattaaaatatgcaattccggtctatcagccattaaaagtaagagcagaagagtttgtgaaagtgttagaagaaattgcaccggatatcattgtggtagctgcatttggacagattatttcaaaagaaatcttagaactcccaaaatatggatgcatcaatgtacatgcgtccttgctgcctgcctatcgaggagcagctccgattcagtgggctgtcattaatggcgataaggaatctggtgttaccattatgcagatggatgagggactggataccggtgatatgattgataaagtggttgtaccgattgaaaaagaagaaaccggtggaagtctgtttgataaattaagtattgccggagcaaaactctgtgtaaaagtaatggctgatttagaagcgggagtggcagggcgcattcctcagccggaagaaagtactacaccttatgcgaaaatgattagtaagcagatggggaaaattgactggaatcgtccggcaaaggagattgaacaattagtacgtggattaaatccatggccgagtgcatataccagtatgaatggaaaaaatttaaaaatctggagtgctgaagtattagaaaaatcagaagcggatgaggcacagacaggacagattctgcgtgcagataagaatggacttcttgttcagacaaaagagggctgtttaaatatcaaagaattacaattggaaggaaaaaaacgtatggatacggcttcttttcttcgtggatacccggtggatacaggtttgacattaggggataagtagaatggtggttcaggtaaatacgagagaattggtattgcagacattgcttgaaattaataaagaaggtcagtatggacatattgcaatccgcaatacactggaaaaataccagtatttggaaaaacaggaaagagcatttattacaagagtctgtgagggcacacaggagaatcagattaaaatcgattatatgattaatcagttttcaaagattaaagtcgaaaagatgaaaccggtgattcgcgaaattttaagaagcagtgtctatcagatgttttttatggattcgattccggataatgcagtttgtgatgaagcagttaaattaaccagaaaaaaaggattctataatctgacgggttttatcaatggtgtactcagacaaatggcaagaaggcgaaagagtattgtattcccggaaaaatcaaatgagaaagaatatctttcgattgaatattctgtaccggaatggatggcagaaaagtttttaaaacagtttggatttgaaaaaaccgagaagattttggcttcttttatgcaggagagaccgcttaccgtgcggatccgcaagtctgagattaataaagaagaagtactggaaagcttaaaatcagaagggatacaggtagaaaaagctccttatctggaaaatgcgtattatttaagcggatatgattatcttccggcgttagaagcatttcgtgccggaaaaatacaggttcaggatgtcagttccatgctggttgctgaaattgccggcataaaagcaggagattttgtagtggatttgtgtgctgccccaggaggaaagacccttgcggtggcagacaaattaaatggaacaggcaaggtgagttccagagatgtcagtcagaaaaaagtagaattgattcaggaaaatgtcacccgcatgggatttcataatatcgaagcaagtgtaaaagatgcgacggtatttgactcttctatcatggatcaggcggatgttgtcattgcagatgttccatgctcggggcttggagtaatcggcagaaagaaagatattaaatacaatatgactttggaaaaaatcaaatccttagttccacttcaaagagaaattctggaaaaagcagcctgctatgtaaaaccggggggtgttctgatttacagtacctgtacgattaccaaagaagaaaatacaggaaatattgcctggtttatttcaaactatccatataaattagaaagcattgagccttatatctgcgaagaacttcactgtaagacaactaaagacggctatttacagatgcttccgggaatccataagagcgatggattttttatggcaagacttaggagggtggaataaagatgcagaaaacagatattaagtcccagactcttgaggaactcaaaaacaccgttttggaattgggagagaagccatttcgtgcaaaacagctctatgaatggatgcatgtaaagctggcggatgattttgatgagatgaccaatctctcaaaagatttccggcagaaattaaaagaaaactgtacgttgactgctttaaaaaaagtggaagttcagatttccaagatagatggtacaaggaagtatctgtttgcactttcagatggaaatgtggtagaaagtgtgcttatgcgctatcatcatggaaatagtgtgtgtatttcttctcaggttggttgtaagatgggatgccgtttttgcgcttcgacgattggaggctggacgagaaatctgaccgctgccgaaatgcttgaccagatttatcagattcagaaagattccggcgagcgggtatcaaatgtagtagtaatgggaaccggcgagccactggataattatgattccctgcttcgttttatccgtatgttaagtgacgataagggtttaaatatcagtcagagaaacatcacggtttctacttgtggaattgtaccgaagatgtatgaacttgcggaagaaaaacttcagattacactggcgctttctctccacgcttcgagtcaggaaaaaagagaagaattaatgccgattgcaaacaagtacagtctggatgaagtacttgatgcatgcagaaattattttgaaaaaaccggcagaagaatcacatttgagtacagtctggtgggcggaaaaaatgattccgaagaggatgcacagcgtctggcagaactgataaaaggtttaaactgccacattaatctgattccggttaacccgattaaagagcgaaattttgtccgctcagaaatgaaagttatcttaaattttaaaaataaacttgaaaaataccaaattaatgttactattagaagagaaatgggtcaggatattgacggggcctgtggacaattaagaaagagttatatcgataacaaagaggattcgtaagatgaaatcatattctattacagatgtgggccagatacggacactcaatgaggacttcgtatttgcctcagatacccctgtgggaaatctgccgaacctcttcgtagttgcagacggaatgggtggacacaatgcaggtgatttcgcgtcaaaatatgcagtggagacactacttgagacaatccgtgttaatcctgagaataatccaattaaaatcatccgtactgcgattgagactgcgaacagttctatcttaaaagaagcggcagaacatgagacaatgagcggaatgggaacaacgatagttttgacaacaattgtaggtgattacgcttatgtggcaaatgtaggagatagtcggctgtatctgattaacgacgagaggattattcagattacaaaagaccattcactggtggaagaaatggtgcgaatgggcgaaatttccgaggaagatgcaagaaatcatccggataaaaacgtgattacacgggcgcttggtgcaacaaaagatgtagcagtagacttctttgacgttcatttagaaccgggagacaggcttctattatgttccgacgggctgaccaatatggttttagatgaagatatagaagacattattgtttctgaagaattgcttgaaactgccggtaaaagactggtagaagcggcgaatgaaaatggaggcaaggataatataggaatagttctggtagaaccagacacaaaagaggtggaagtatgttagatgtgggagttattgtaagtgaccgctatgagattgtgggttgtgtcggctccggtggaatggcggatgtatacaaagcgaaagatcataaactgaatcgttttgttgcaataaaggtattgaaagcagaatttggttctgatacaacctttatcagtaagtttcaaagagaagcacaggccgcagcaggtctggcgcatccaaacattgtaaacgtgtttgatgtaggagaagataatggcattaattatattgtaatggagctggttgagggaattaccttaaaagagtatatttccaaaaaaggcagactgacgataaaagagacaaccagtattgcaattcaggttgcaatgggacttgaagcagcgcacaataaaaagattgtgcatcgtgatatcaaaccgcagaatattattatttctacggatggaaaagtaaaagtaacagattttggtatcgcaagagccgcttcttccaatacaatcagtaccaatgcaatgggttcggttcattacagttctccggaacaggtacgtggcggttacagtgattataagagtgatatctattcattaggtatcacaatgtatgagatggtgacaggaacggttccttttgatggcgatacaactgtttctatcgcaatcaaacatcttcaggaggagatgataccaccgtcagaattaaatccacagcttccacacagtctggaagaaattatcatgaaatgtacccagaaaagtccggacagacgatacaattcactggcagagttgatcagtgatttaaaacagtctttgattgatccggacggaaatttcgtaaatctgactccactgagtaatcatgcgcagacggttgtaatctctccggaagagatggaacagattaaacgaggtgcagtggcagcaggaaataccgtgccggaaagtaatccggaagtaaattatgaagattttgaaattccggacgaagatgaatatatcgacaacaacgcagattatgattataaagatgatgtagatgactatgatgcagaggaagaagaaccacacaaaaaaggaatcagtcatacattggaaaaggtgatgacaattggtggaattgtggtaggagcaattattatctgtgtcttagtttacacaatcgcatcagcttcgggcttattaaaattcggttcctctaaaaataataacagtgggaatacgacggcttcagacagtaaatcagaaaaagattcagacagcagtgtaaaacaggtggaagttccggatttaacaaacaagacaccggaagaagcacagaaaacattaaatgacttgcagttagggtataagaatggcggagaagaagcatctgacagtgtagcagagggaaatatctgccgtcaggatgtagaagtaggaacaaaagtagagccgtatacacagattacctgttatatcagcagtggaacagaagaaattcaagtaccgtatgtgactgactattcacagacagatgcagaagcaatgttaaaagaattaggcttaaagacagcggtacagaaagcaaacagcagtgacattacaatcggaaatgttgtttcaactgacccggaagccggaacaagcgtaaaagccggagatacggtaacgttgactatcagtatcggagaaggagatactgcagtacgtgtgccaaatgtgattgggacaagtgaagcggatgcaaagagtaccttaagtcagctgggacttcttgtaagcgttcagacaggaaatgaccagtctgtaaacgaaggagaagtttataaacagagtgtggacagcggaacgagggtaaatacaggagaaacgattacaatttatgtaagaagcagcagttcttcggatgacgaagacagtgaggacagcaagacagataaagataaaaataaaaataaagataaagataaaaattccagcagttcctctgatggaacatggaagcctgcaaacagccttcagcagccgaccaattatcagggtggaaaagtaaaagtagaactggtacagacagatgatgatggaaatacttattcggaccagtcaatggaagtggacgacccacagtttccgttgtccattcaggatttaaatggtcatcctggaattacaagcggaactgtagtgctgtatgaatggattgatgacagctatcagattattgaccagtatgatgtttcttttaggcaggtaaattgatgattggaaagattatgaaagggattgccggattctactacgttggtgtagcagaatccggagtctatgaatgtaaagcaaagggaatattccgaaaagataaaataaaaccccttgttggggatgatgtggaaatagaggtcctgaatgaagaggagaaacttggaaatatcgtaaagattcttccaagacgtagtgaattgattcgtccggcagttgcaaatatcgatcaggcattggttatttttgcagccagagaaccaaagccgaatctctctttattggaccgctttttagttatcatggaaaaacaggatgttcctgtgattatctgttttaacaaacaggatttatgtgacgaagaagaagttggacgtctcaaagagatttatgaagcctgtggctatccggtggtgcttgcaagtgcaaagcagggtgaggggattgaagaaattaaatcactgcttcgtgggaaaacgacaacagttgcaggaccgtccggagtgggaaagtcttcattgacgaatctgcttcaaaatgaggtgcagatggaaaccggggaaatcagtaaaaaattgggaagaggtcgtcatacgacaagacattcacagatcattcagatagaggaagatacctggctttatgacacaccaggatttacctctttttatgtagaagaaatcgaaaaagaagaattacgtttttattttcgagagttttttaaatacgaaggaacatgccgttttcagggctgtacacatacgcatgaaccaggatgcatggtaaaaaatgcattggaagaaggaaaaatctcaaaagaaagatatgaaaattatcttgaactctatggggaattaaaagaaaaaagaaggtattaggagggacaatatgtatcagttatcgccatcaattttatccgcagattttatgaagttaggggaagaaattaaaaaagtagaagaagcgggagtcgaatggcttcatattgatgttatggatggaatatttgtaccgagtatttcattcggaatgccggtgatttcttcagtcagaaaaaaatgcagtctgtttttagatgtacatcttatgattgaagaaccggctcgttacatttcgcagtttaaagcagcgggagccgacatgcttaccgttcatgcagaggcctgtaagcacctggacagtactctttatcatattcgggaagccggaatgaaagcaggggttgcaattaatccggcaacaccgctttgcgtagtggaagaggtacttggaattgttgatatggtgcttattatgacagtaaatccaggatttggagggcagaaatatattccgtatacgacagaaaaagtaaagcggttaaaagaaatgctgaaggacaaaaatctggatgtagatatcgaagtagatggtggaatcagtaagaatacaatggatctggcattggatgcaggagcaaatattctggttatgggttctgcgatttttaatggagaggcaaaggaaaatgccatgatgtatcagaatcggttggaggcttatgaacatgaacacagtgctgatttgcggcggtgaaatcaatgatgagtttagcttagtctgtttaaagcagataaagccggactgtattatcggggtcgataaaggattagaattttgctatcgaaatcatgtcattccggattggattttaggcgattttgacagcatttccaaagaggtgatagactggtatagagaacagcaggaaattccgattcgtcagtataaaccggaaaaggatgataccgatgccagacttggaatggaactggcactaaagttgggcagtgataagatttttctgcttggggcaaccggaggaagattagaccattatatgggaaatcttcagtcgctcttaattacggcaaggaaagaaaaagaaggctggattttagatgagcaaaatgcaattacggttagaagagcaggaaaaatttgtattcacaaagaagaacagtttggaaaatatgtttcgtttttctctatgggagatgaagtgacaggattgtctttaaccggattccagtatccgctggatggttacactctgaaaaattcagatggaatcgcagtcagcaatcagttgttggatgattgtggtattatagaatttgagaccggttatctgatgatggttttgtcgaaagatagaacaaaatgttgataaattttgaaaacagctttaatctgaaataggattaaggctgttttttgattttagcagaaaatagcagacttcttgcaatctaagaatttactttttggatttgttatgctatagtatagaatgagtcttggggctcttttcaaaagaatcaggagatgttcctgttacaatttagtggtgaaaacccataggcttgcctgtggaagtagtcagtacataggataaaatagaaaaatacaaaaaatgtatgattggattctttttatcagacctaaagagagtttaaatctacatgggatagattgaaggaggagatacaagaaatgaaattaggaattgtgggattgccaaatgttggtaaaagtaccctttttaattctttaacgaaggcgggcgcagagtctgcgaattacccgttttgtacaattgacccgaatgtgggaattgtaactgtaccagatgaacgtctgaaactgcttggggatttttatcattccaagaaagtaacaccggcagtcattgaatttgttgacattgcaggtctggttaagggtgcttcaaaaggagagggtcttggaaaccagtttcttgcaaatatcagagaagttgatgcaattgttcatgtagtacgttgttttgaagatgaaaatgttgtacatgtagacggaagtattgacccgcttcgtgatattgaaaccattaatctggaactgattttctcagatattgagattcttgacagaagaattgcaaagacaacaaaaactgcacgtatggataaagaagcagcaaaagaactggaattattaaagaaattaaaagaaaccctggaagaaggaaaaccggcatctgtatttgaaccggaaaatgaagacgaagaggcactgttaaaaggatacaacctgctgacaggaaagccggtcatctatgcagcgaatgtttcagaagaagatttggcagatgatgccgtttctaatccacatgtacagaaagtaagagaatatgcaaaagagacaggcagtgaagtgtttgcgctttgtgcacagattgagcaggaaatcgcagaattagatgatgatgagaaaaaagaatttttagaggatttgggaattgaaaaatccggattggaaaaactgattgtagcaagttatcgtctgcttggtctattaagctttttgacttcaggagaagatgagacaagagcatggaccattaaagtgggaacaaaagctccgcaggctgccggaaaaatacataccgattttgaacgaggatttattaaagcagaggttgtaaattatcaggatttattggattgtggttcttatgcgggcgcaagagaaaaaggacttgtgcgcatggaaggaaaagagtatgtggtacaggatggcgacgtaatcttattccgctttaatgtataaggaggaaaaatgatatggatatgtccattcgtttcccacatttgggaatttatctgccgaatgtaggaaaaacaatatcagtctttggatttgatattgcatattatggaattacaattgcaatcgcaatgattgtgggaatctccattgctctgcatgaggcaaaacgtaccggacaaaatcaggatacctatttggatttactgatgcttaccatgcttacttcagttgttggagcaagaatatactatgtcattttttcatgggataattataaggataatctgggcgaaattttaaatatcagaaatggcggtcttgcaatttatggaggaattatagccggagctattacggtttttatttattctaaaataacaaaaatgaaattcttacaaattgcagatactgtatgtatgggactggcagcaggacagattatcggacggtggggtaatttctttaaccgtgaagcatttggagaatatacgaataatctcctggcaatgcagcttccggtatccgcagtgcgcaaaaatgaaattacttctgctatgtggaaccatgtagtaacaatcggtggagtggaatatattcaggtacatccgacttttctatatgaaggactttggagttttatggttcttctgtttctattctggtttcggaagcgaaaaaagtttgaaggagaacttttcttctgttatcttgcaggatatggagctggtcgtttctggatagaaagtctgcgtacagaccagctgcttttgccgggaatccatgtaccggtttcccagatgctttcagcagtgttggttgttgtttcactttcagtgattatttgtaaaagaagaaagaacagggagtgtcgttatgacaaaagaaaccttaaaaatacagattgaggacacaagaaaatacttgaatcagagtataactgaaaaacagagtgcagataagattctggaaatcagtgtaaaattagataagttgattgaagaatatttaaatacaaaagaataaaacaactgttcgcaaaattgaatgggaagaagaattaaaatgccgcaaatcttttgatattgcggcatttttcgagaaaactcagacataaggggaatatatgttccccttgctttttttacagtggtagtatagaatggctttgtaagtggtaagatgtggtgaaagtgacggtaaataggggacttatggcagaagtcacagttatttccgttaaaaaacagaagaaagaagcatatttttcacccgaaaaaacagaaaaaattactactttttgataaaatgcaagaatcttctcacgtttcttcgtttcagagcaggccgatagtgaaccggacaagcaggggagaattctcgcgccggcaaggatgcgggagtttgcgggtctaagatattcaagtcaaatgcttatgagacttaaaaataccgtctggaaacctcgcccgaattgcaagtgaatgacaggagggtcaggagaatggaatttaaacacaaatccgtcttgttaaacgaaacaattgagaatttaaatattaaaccagatggaatttatgtggacggaacgctgggaggagctggacattcttatgagatatgtcgtcagttgtctaccaaagggagtttaataggtatagatcaggatgaggctgcaatagaagctgccagtaagcggttagaagaatttcaggaccgtgtgacaatcatacgcagcaactattgcaatatgaaaaaagaattaaaccgtaaagggattttttctgtagatggaattgtacttgacttaggggtttcttcttatcagttagataacgcagaaagaggatttacatatcgggaagatgtgcctcttgatatgcgaatggatcagagaggaagccggactgcaagggatattgtcaatgaatacagtgaacaggaattatttcgtgtaatcagggattacggtgaagataaatttgctaagaatatagcaaaacatatatgtacagcgagggctgtgaaaccaattgaaacgacaggagaattgacagagattatcaaacagtcgattccgatgaaaattcgtgcaacgggaggacatccggcaaagaaaacatttcaggcaatccggattgaactgaatcaggagcttgaagtattaaagaactcattagatgatatgatagaactgctgaatgatgaaggacgcatctgtattattacgttccattcattggaagaccgtattgtaaagacaattttcaaaagaaacgaaaatccctgtacctgtccatctaattttcctgtatgcgtatgtgggaaaaaatcaaaaggaaaggtaattaccagaaaaccgattcttccgtctgaggaggaattagaggaaaacacccgttccaagagtgcaaaattaagggtgtttgaacgtatcaggcaggaataaaaagtagataataaggtggcatcatgagcagatataagatagatggaaatactgcacgccgcgaaaatgagagccagcaaaagaaaaataaaaagaaagtgtcagtcagaaatcagaaaaaacagaagccgaaattgaatcgtaaatttgtatacagtgtacttgcaggttgtattatggtaaccatggcgagtacacattatcttcaattaaagtcagaaatggcaattcagaaaaaccggctgacctctcagaaattagaatatagtgagttaaaggcggataatgatgcgtactatagcgaagtgctttcaagtgtagacttggaaacgatacggaaaaaagcattggatgaatttggtatgaagcatgcgaccgaggaccagattaagtattatacgccggacggtgatggctatgtaaggcagtatcaggaagtaccggaagagtaagagcgaaggcagagcaggtggcagtttgaaaagacaacaaaaaaaaggaacaaaaagacttacaaagaaaatgaaaacgaagctggtgggattactgattgtaattctgctggctttagtcgcgttaatatttcggattacttatatcagtattaaaagcggtgacagatatacaagacaggtattaacccagtcccagcagcagtatgaaagtacgacagttccatttaagaggggcgatattctggatagaaatggcaatacccttgcaaccagtgtgaaagtctataatgtaatcttagattgcagtctggtaaattcagataaaaaatatcgtaaaccaacagtggatgcattatcggattaccttggaattgacagcagtgtggtagaagcaaagctggatgatgaatcgacagcaaattcgcagtatcaaattttaaaaaaagtatctatggatgaaagaaaacatttccttgaaatgaatgaaattacggatgataataaagataccttaaaaaggagcgaatacaaacgcagaagcagagtaaaaggggtctggtttgaagagcattatcagagagagtatccatttcatgcactggcaagtacggttataggattttcatcggtgaataatacagcaagccttggaattgaggggtattatagcagcaccttaaatggcacagatggaaaaaaatacggatatttaaacagtgatgacatcatggagcagaatattgtagatgcagtagatggaaagacagtggtttcgacaattgatgtcaatattcaaagtattgtagaaaaatatatttcagcctttaatgaaaaattaagaaacaatgcttatgaaggagacggagcagaaaatatcggagttattgtagaaaatccaaataatggtgaaattctggcaatggcagggaaaaatacctttgatttaaatgacccgagagccgcctatgcgaaccggacggacttatccgatgaggagatcagtgccggattagatagtttatgggaaaatttctgtgtctcatcaaactatgaattaggttcggttatcaaaccgattattgttgcttccgcattagaatccggagcagtcagtgacagtgatgtctttatctgtgatggtggagaacagattggaaatgattatgtacgctgtgcagtttatccttatgcacatggaacggaaacacttggagaggttattcagaactcctgtaatgacggcatgatggcaatcggacgaaaaatgggagcggctttattgttggattatcagtcacggtttaactttggaagccggaccggaattgacctgccaaatgaaagttcaggagcaatttatacgcttgaccagatgaaagatatggaactggcatctacaacatttggacagggatttaccagtaccatgattcaggaaatttcagccgtgtctgcggtaatcaatggtggaacttattatcagccgcatgtggtaaaagaaatcaaatcacaggaagatggctctgtattaaaaaccaatgaaggaaatgtattaaaacagattgtatcttcagatgtttctgaaaaaattcgtgagtacatgggaatgagtgtaacatctggaaccagtagaaaatcaaaagttcagggttacagcatgggtggtaaaacaggaaccgcagaaatcttaagtacaaaagaaaaagattatctggtttcttttattggatttgctccgcttgatactcctcaggttgtggtttatgtagtagtggatcgaccaaatgtagaagaacaggcagacagctcttatgcacaatatattgcacaggcaattttggatgaaattcttccttatatgaacatttatccagatgaagagacagaagaaactacaaaattatgggatggttttaaaggtgttttaaaactggatgattctgaagtagaagtagatgagccggccgtacagacagaaggttctgaaaccggaaccgataatgctccggatatcgaagttgtacaggatgaaagtggctcatcagaagaatataatgatgaagaaagtgacggcgtagcaagtgagaatgtcggatatgaggaaaatgattctgaagatgtgtctgacgaagaggatacttcaagcgacaattttgaagaagatacctcgaaccaagatgactacgaagaagatgagggagaataatagagcctctcatttaaaatagtgagatttaagctaaaaaggaatcctgcaagatgggattcctttttgttgtctgtcatatatataaaaaaaacaggttcaggcagatgaataaaaacagagtctatcacaaaaagaaaacagtaatcgtattctttagctgtctttttttattaacaggtctgatcgtacgtatggtttaccttatggtcattgaatcggattattatgcaaaaaaagcacagactcttcatgaaagagaacgtgacattaaggcagaaagaggaaaaattattgatgcaaaaggagaagttttagcagataataaggcagtctgtacgatttctgtcatacatagtcagataaaagagccggaaaaagtgattgaaatgctgaaaaaggaacttggactctcagaggaaacagccagaaagcgtgtggaaaagcgttcttccatcgaaagaatcaagacaaatgtagagaaagagacgggagaccggattcgggaatatggtctggatggggtaaaagtagatgaggactttaaacgatattatccatatcaggaacttgcttcaaaagtacttggatttacaggcgcagataatcagggaattattggacttgaagtacagtatgatgactttttaaaaggaacagatggaaaaattctcacggttacggatgcaaggggagtggaactggaaaaactgggagagagccggatagagccaattgccggatatgacctgcatgtcagtctggataaaaatattcagatgtatgctcagcaggcagcagaaaaagtaatggaagaaaaagaagcggatgccgtctcaattttatttttaaatccacagaatggagaaatctatgcggacgtcaatgtaccggaatttaatttaaatgaaccatttatgttaggggaagcagaggaaaacttaaatcaaaaagaaaaacaggatgccctgaaccgaatgtggagaaacttaacggttaatgacacttatgaacctggttcgacatttaagataatcacaatggcggcaggtttatcagaaggtgtggtgacaccaaatgaccgtttttcctgtcctggttttaaagtagtggaggatagaagaattcactgtcataaaagaagcggacatggggcagaagattttgtgcagggcgcaatgaattcctgcaatccggtttttattgaagtaggactcagacttggggtagaacggtattatcattattttaaacagtttggtctgttaaaaaagacagggattgatattccgggtgaagccggaacaattatgcataaagaagcgaatatcgggcaggtggaactggcaacgatttcttttggtcagtcttttcagattacaccgattcagcttgtaacaacagtcagttcgattataaacggaggaagaagaattacgcctcattttggagtttatgtgacagacgagacaggaaaagaggtaaagcgatttgaatatccggttgaaaataatattgtgacagaagaagtttcaaaagaagtcagagaaattctggagaaggttgtgtcggaaggctctgggaaaaatgcatttattgaggggcataccattggcggaaagactgcaacatcgcagacccttccaagaagtgagaatcgctatatttcctcttttcttggatttacaccggcagatgaaccggagattataggaatctgtctgattcatgacccaacaggtatttactatgggggaacaattgcggcacctgtaattcgggatatctatgagaatattcttccgtatcttgggattgaaggttgataaaaaaagcaaaaggcattatactactatagaaagaattgccggatgtttataaaagatagactttcggcaaaaaaatacaaagaagaggtgtattatggcagagtataaaatggtttggccagtcttgattgcatttgcaatcagtgtaattttaggtcctttcgtgattccatatttgcggaaactgaaaatgggacagacagagcgtgtagatggggtacagtctcatctgaaaaaagcaggaactccgacaatgggaggcgtgatttttctcttatcaacagttatcacatctttattttatataaaagattatccaaagattattccggttttatttttgacactgggatttggaattattggatttttagatgactatttaaaagtagtgctgcgtcgttcagacggtctgatgccaggtcagaaaatggcatgccagattgttgtaactgcaattttcgcattttatattatgaaatttaccgatgttcagatgactttaaaaattccgtttgtatccggttatgagttaaatgcaggaattttaaccgttccgctgttattctttgttgtaatcggcactgtaaatggagtaaactttacggatggtctggatggacttgcttcttctgttacgattatggtggctacattcttctccgtcatcgcaattgcaacaaagagtggaattgaaccgattacctgtgcggtagtgggagctttaatgggatttttgttatttaatgtatatccagcaaaaattttcatgggagataccggttctctggcactgggaggatttgtagcaggtactgcttatatgttacagatgccgttatttattttgattattggttttatttatttgttagaagtagtatctgtcattttacaggttggctactttaaaatttccggtggaaaacgaatctttaaaatggcaccaatccatcatcactttgaactgtgcggatggtcagaaaccagagtagttgcagtattctcaattgtcacagcaattttgtgtatgattgcacttttaggtgtgtaaaaagaaaggaaggaaattatgaaaaagacagaattacaggggaaaaaagtattagtcttcggttccggaatcagtggaatcggggctgtaaaactgttagaaacggtacaggcagatgttgtattatatgatggaaatgaatcattaaagaaagaagaaatcagagcaaaacttccgaaagaaagcaaatgtgaaattgtacttggagaattaaaacaggaactgattgacagtctcaatctggtcgtgatgagcccgggagttccgcttgatattgaaccggtagaacgcttaaaagcagcagggcttccaatttggggagaagtagaacttgcatactgcatgggggatggaacagtccttgcaattaccggaacaaacggaaagacaacaacaaccgcactccttggagaaatcataaaggcttatgcagattcggtatttgttgttggaaatattggaaatgcttatacaggagcagcttcttccatgaaagaagaaagctatacggtagcagaaatcagcagtttccagttagagaccatacatagttttcatccaaaggtttctgcaattttaaacattacagaggatcatttaaatcgtcatcatacgatggaagagtacattcgtgttaaagagctgattgcttctaatcagaccaaagacgatttttgtattttaaattatgaagatgaggaacttcgtaagtttgccccaaaatgtccggcaactgtagtctttttctccagtgttcagaaacttgaagagggaatcttcctcgatggagaaaatattgtatggaaatcaaaaacagaagaatttgtatttgcaagaaccgatgaattaaaattgcttggtcgccataatcatgaaaatgtaatggcagcttccgctatggcatactgcgcaggtgttccaaaggaaactattcgcaaagtgattatgcgttttactgctgttccacacagaatcgaatttgtagaagaaattaatggagttgcttattacaatgactctaagggaaccaatccagatgctgcaatcaaaggaattcaggcaatgaaccgtccaacgctcttaattggaggcggatatgataaacagtcctcttatgaagaatggattcaggcatttgatggaaaagtaaaacagttagtattaatcggtcagaccagagaaaaaattgaaaaaacagcgcatgaatgtggatttttcaatacgattctggctgaaaaccttgaagaagcagtaaaaatctgtgccgaaaaagcagaagccggagatgcagtactgctttcaccggcatgtgcaagctggggacagtttgataactatgagcagcgtggagataaattcaaagagtatgttcgtgcaatgctttaattgacgttgtcgtagagacaattcataaataataaaataaaatcatatagtgcaatatgagaaaaacaaaaaaggaaatgcttatggaagccgtaagagaaccaaaaaagagtatggacagcatacttttgtttctggtacttctgctcgtcgtgtggggcttgattttcttgtatagcacaagtgcatataatggcagggtgaagtttcatgaccctgcctattattttaagaaacaactttttgccacgtctttagggctcatagcgatgtatttggtttcctgtatcgattatcatattgcggtgaaatttgcccctcttttttatctggcatcaatggggctgtctttggcagtgcttttgtttgggcaggagtataatggttcaaaacgatggctgtcaattggaccgttttcatttcagccgtccgaatttgcaaaagcggcagtgattttatttcttacatttcttatcacaaattcacagaaaaaaaaggatggtatcttttggatggcaggaattatgctgccacttttgccgattgtaggattggttgggacaaataatttgagcacagcaattatcattcttggaattggcgttattttagtttttatttcgcatccgcgttatcttccatttattggaattggggtggcgggaacggtatttatcgctatttttctcggggcggcgagttatcgtctggagcgtcttaaaatctggagaaatccggaagcttatgaaaaaggatttcaaaccattcagggactctatgcaatcggaagtggagggatttttggaagtggacttgggagcagtgttcagaaacttggatttgttccagaagcgcaaaacgacatgattttttcaattatctgcgaagagaccggtctgtgtggtgcagtgctgctgataatgttgtttgcacttctaatctggagattgatggtaattgcaacccatgcaggggatttagaaggagcattgatttcgggaggaattatggggcatatcgcaattcaggttattttaaatattgcggttgtgacaaatacaattccaaataccggaattaccctgccctttgtcagttatggagggacttctgttgtatttttactgggagagatgggaatggcgcttgcagtcagccggagaggaaagagggagagcaggtagcattttaagaaacggtgcatactataggatatagagagcgacggaaggaagaggcagatttgaatcaaatccgtattgagggatttcatcgtctgaatggagaagtaagaatacagggttctaaaaatgcggcattgccaatgatggcggccgctgttttatgtaaaggagaagtgattcttcatcattgtccggatatcacagatgttcatctgatgaaagaaattataaaggggcttggtgggaaggctttttataaaaatcataccatgtatctggattgtacaaagatagagcggactacaattcccaaaaaagaagcagagaagatgcgttcttctattgtgttaatgggaagtcttttaggaagaaaaaaggaggtctgtattccctggccggggggctgtgtgataggaaaacgtccaatcgatcttcatctgtctgcccttgaaaaaatgggagcagaatttacagaagaagacaggggacttaagggaaaaacagaaggactcaaaggcgccagaattgtatttccaaaaatcagcgtgggtgcaacgcaaaatgtaatcctggcatccgtacttgccaaaggtacaacgatactggaaaattgtgcctgcgaaccggaagtgcagtggctgtgccggtttttaagaaaaggtggagcaaaaataaaagaaacgaaaaatcgaatgattgaaatcgaaggcataaagtctttacatgcagttgaatacgaagttccgccggatagaattgtagcaggaacgtatctttgtgcttctgcaattacaagaagcaatatttgtctggtcggagcaccaaaagatgagatgaaagcaatcttatcgctctatcagaaaatgggtggacaatacgaatggattggtggtaaactgtctttgtgcagtcaggaagtaaacgttccggttttatgtcaaaaaacggaagtttatccgggatttccaacagatttacagtcaccggttctggcagtgctttcaggtattaaaggaaaaagctgtctgatagaaaccatttttgagaatcgttttcgtgtagcaggggaacttaaaaaaatgggagcaaatatccggattgatggagcaaaggcagaaatttatggaggaaaactgcatggggcagaggtagaagcgcaggaacttcggggaggtgcggcactggttctggcaggactggcggcaaaaggagtgactacggtaaagaatatcgaatatatcgagcgtggatatgaggatatctgccgtgatttgagtcagcttggagcagtgatggaaagaaaataaaggggattattttatatggataaaaagaaacgcacgaagattttgggcggtattgtggcagtgctgttgcttggaattgctgtttttttcggcggttttcgggttacaagtgtaaaagtagaaggaaatacagctcatacagataaagaaataaaaaagatggtgcttcaaggatcacttgcttcaaataccatactggttcgttttttaaatccgagcgaaaaaacaaaagatgaccagtttattcagaaagtatggattgagcggacaagcagtcataaattaaccattcatgtaagggaaaaagaattaattggttatacgaaatttttggatggatatctgtattttgacaaagaaggaattgttcaggtaagtactacaaaagaattgaaaaatattccatttattgaaggattaggccagaaaaaggttcaggtaggacagaaattgtccggactaacagatgaaattctgggcatgcttttaagtgcaacaaagatgatggagagtagtgaacagcatccggaccgaatcgtcattgaaaatggagcacttaccatgtatttttcggaaatcgaagtaaaacttggcacggaaaaaaatatttcagataaaataagcaaaatgctgggaattttgccacagcttgaaggaatgcagggcgttttggacttacagaatgtggactccacgacagagaccattgtatttaagaagtcagagacacaaaagagcacagaagaaaatcaaaatgagtagaggcagtaaagtaaaaaataaaagaatggaaaaataaaaaaatcggtgtcgaagaaaaaagaaactataagaataaagtaaaaatttaaattttttatgaaaaaatgaaaatagcggttgattaatttttgaaaagaagatattatatatctatatgcacgaaccttggaggagaataggatttggcataagcgtaaaatcagaagaaatacggaatgcaatacatgaaagtgtatttaaaaaccatacaggtaagctaaaggaggaagtactttgttagagattatgacaaacgaggctgaatcatctgcaaaaatcgtagtcattggtgtaggtggagctggtaataatgcagtaaacagaatggtggaagaaacaattagcggtgtagaatttgttggagtgaataccgataaacaggcgctgacattatgtaaagcaccgaccgttgttcagattggtgaaaaactgacaaaaggtcttggtgcaggagcaaaaccggaaatcggtgaaaaagcagcagaagaaagcatcgaggaaattaagcaggttcttcagggtgctgatatggtatttgttacctgtggtatgggtggcggaaccggaacaggtgctgctccaatcgttgcaggtgcagcaaaagaaatgggaattttgacagttggtgttgtcacaaagcctttccgttttgaagcaaagacacgtatgacaaatgcattgacaggtattgaaaaattaaaagacaatgtggatacattaattgtaatcccgaatgaccgtctgcttgaaatcgttgaccgtcgtactactatgccagaagcattaaagaaagcggatgaagtgcttcagcaggcagttcagggaatcacagatttaatcaatcttccggctctgattaaccttgactttgcagacgttcagactgttatgattgataaaggaattgcacatatcggtatcggtgaaggaaaaggtgatgataaagcaatggaagctgttcagcaggcagtatccagtccacttctcgaaacaaccatccagggtgcatctcatgttattatcaacgtatccggagatatctcccttatggatgcaaatgatgcagcaagctatgtacagaaccttacaggcgaagatacaaacattatctttggtgctctgtatgatgataaagaagcagattatgtaagaatcacagtaatcgctacaggtcttgatgatgaaacagcaagaaaaccaagcgtatcccgtgataaaaaaactgcaaaaacagaagaagtggtacagcagccggtacagcagactgcacacgtagaaactcagcagccagcttttaagatgccgactttccagcagccaactttcggaagcaatacaggtaacttcacaagtactgtgccgaagaaagatattcagattccggatttcttaaaaaatagaaagtaatacgatatacactacaaaagataaaggcggttcagattagttctggatcgccttttttagtcaaaagtttaaggagaaaaaagatggaaacaaagtttactcattttgatgaacagggaaatgcagtgatggtggatgtttcagaaaagaatccgacaagccggactgcattagcagaggggaaaattcaggtcaatcgtgaagtgatggatgcgattcttcatcatacagtaaaaaaaggggatgtgctgggtgtagcgcgtgtagccggaattatggcagtgaaacagacttcttcgttgattccgatgtgccatgtacttccaatcagtaaatgcagtgtagattttgaaattgaagaagaaaatcttacgattaaagccttatgtatggtaaaagtagaagggaaaacgggtgttgaaatggaagcactgaccggagttaatgtggctctgcttacgatttacgatatgtgtaaagcaattgataaacgaatggtgatgacggacattcatctggtagagaaaaaaggtggaaaaagcggtgacttttattttgaagaaaaataaaagccaccgatattcaaaattaaaaatttttcaagagaacatcatttttggagagactattattattttccaagtgtttctctaactaattccactggcatttcctgaccggtccagattttaaatgcttctgcaccttgatacaaaagcatggaataaccattgaaagcaatacagcctttttcttttgccattttaagcagtttggtttcccatggattatagataatatcagcaacagcaaggtcttttcttaaaagagaactgtcttctaagatgcaggtatctgtatttggagccattccgacagatgtggcatttacaaaaagtgtactttgttccagactgtgctttaaagcagttgtatcgttatgatcaaaaacagtaattttgcaggagctaagtgcggaaagtttttgaatgacttcgcggatacgtggaagataacggctggttgagcgggcgaagatatggatttctcccacattatcaagtgcagcctgagcgcagattgcagtagcggcaccgccaattcccataagggtgattgtctttcctgttacatcaatgccgtgttctttgactgagcgcataaacccaatgccgtcggtgttgtgtccgattaactttccatctttgttttctacggtgttaactgcaccaatacactttgcagcaggggaaagttcgtccagatattctaaaatttttgttttgtttggcatggttagattgaagccctttacacccattgtttttaaggctttgacggcatctccaagcgtctgttcattgatatcaaagcaaagatagacataatcaagaccgagtgcggaaaaactggtattatgcatcataggagagatgctgtgtgccaccggacttccaagaagacaggtgagttttgtatgtcctgtaattggtatcataattataaaacctcactttcattttgttacattaaagtttaaaaggaaaaaaatagagtgtcaagtagaaaagaaaattcgacaagataagagggaaagataatctttttgataaaattcgacaaaaatgtcgaaaataaatcaaattgtgataaaaattatgtaaaccggaaaataaaagaaaaaaataaagttttgcatcaaatagtttacataaagaaggtgacataaagttgcctttcgatgtcgaaaactatcggattttagcaaaaaatttttgggaagagccttgtgattttgacagaattcacacccccctagaccttataatgaacattacttagttccagataagtaattgagtcaaaaaggtctaggggggtgttttgtgtactacgaattttacatagatgtgtttttcgtagtcaatctggtaatggatttttttatcctgcagttggtgaaccggatgattttgggggctgccaacccgcttcgttcacttgcaggagctgtactgggagcagtaggaagcggtgtgattctttttttaccgttttcttcatggaaaataaggggtctgatttcctatgggattttagcaccgcttatggttatggctggatgtggaacaaaaaataagaatgtattttggatggaactgcttggcttttatggatgttctgctttggcaggaggaatttttctggcatttcccaagattgcagcaagaggaatcatcacatttttggcgttatcgtcagtcacttactggatgcttgtcatcagtatcagactcttaaaatacttaaatggaaaaaggagtactctttgccagattcaaattcgggcaggaaaaagacaaataaaagtgaaaggtctgtatgacacaggaaaccagctttgggattctttgttaaagaagccggtctgcgtgattgaatatcaggcatttaccggtcttttaagtgaaccgcagaaaaaagcgtttgatgctcttataatgcggacccaaaacgcatcggatagtctgacagaaagcctcatctgttttgaaccacactttatctgttttttaagtgtgggaacaaagagaggaagcctgcttgtcgtaactgtagatgagatgtctgtagaacgaagagaacggcgggtatccgtaaaaaaaccggttttggcacttgtaaaacaggatatgtcagtagataaaacctttcagatgattataaatccagaagtttttgacagttaggaggcgcttgtgatggaaacagcagttgtaagaagagttcaattccctgtttttacaggaatgattttgcgaagaggagaagagattcactatattggtggtgcagatgtactgccggctcctcttgatatacagacagagaccttaatgatagaaaaactgcagaccgatgagtttgaagaggcaaaagcaagtctgattgaacataatctgcgtctggtggtatacattgcaaagaaatttgataataccggagttggagcggaagatttaatttcaattggaacgattggactgattaaggcaattaatacctttaaatctgaaaaaaaaatcaagctggcaacttatgcttcaagatgcatcgaaaatgaaattttgatgtatctgagaagaaacagtaaaacgaaactggaggtttccatcgatgaaccgcttaatgtagactgggatggaaatgaattacttttgtcggatattttggggacagatgaagatgtaatttatcgtggaatcgaaagtgaagtggagcggaatctgcttggaaaggcaatcagtaaattaagtaaacgggaacagacgattatccgacttcgttttggcattaatatgccggatggaagagaaaaaactcaaaaagaggtagcggatttgcttggaatttcacagtcttatatttcaagactggaaaaacggattatgaaacgcttaaaaaaagaaatggtacgatatgagtaattagaatttaagaaatcccttctacaggaataaatcttgtagaggggattttttctttcctactttttctttctattatgcaccctgttcgatttcttttttgacttgaagaacaagtgggataatttcctgaatccgtttatctgtcattcgggtgacaggtgcagagatagaaaacgcatagcgggaacgacctttatagtcggtaagtcctacggcaatacagcgtacgccaagttcgttttcttcgttatcaagagcatagccattctttctggcttcttttacctcttttaaaaaggtgtcatagtctgtaatggtatgccgggtcagttttttgtgggtgcaggcatcccataatttatgaatctgggattcttccatgccggctgccattgcttttccaacaccggaacagtagagcggaatccggcttccgactttggaaaccatccgcacagagttttgacgtgactcttctttgtagatataaaccgcttccgagccatcgagctgtacaaaatgaactgtctctccggtttcttgagagagtgattttaaataaggtcggacaacttcaaggatatcgagtcgttctaacagacagttggataatgccagtacttttaaggacaggtcatacttctgggtttctgaatcctgctttgcataccccatataaatcaaggaggatagtagtcggtgtgtggtacttttatttaaatttaattcacggcttaaatcagccagtgaaacaggtccgatttttgacaaagtttccatagcaagaaacagccgatctgcaacctgaatagggttttttgattccataagatatcattttcctttctaactgtaacgatattatgttgaggatggtcttagatttgaggattgaggggaatttcgattcataagactttggcgctattgtaacactttccggaatgtgttacaaccagaaaattttttttgaaaggggcttgacaatatggagatctgtagtataatccaaagtaaagatatcgtattgtgaaacatagttccacattatgaaactagcggaaacgaaaaaaattatttttaaaattcaaggaggacattatgaacgcagttttagaacagctttccaaatttggcgtagtaccagtagtagtattaaatgacgtaaaggatgcagaaccgttggcaaaagcactttgccagggtggacttccatgtgcagaagtaactttccgtacggatgcagcagaggaatctattcgtatcatgacagaaaaatatccggaaatgttagttggagcaggtactgttctgacaacagagcaggttgaccgtgctgttgcagcgggcgcaaaattcatcgtaagcccaggatttgacccggaaatcgtagattactgtattgaaaaaggtatcacagtaacaccgggatgcgtaacgccttcagaagtagctcagggtgtaaaacgtggattaaaagtattaaaattcttcccggcagaacagtttggcggagttgctacaatcaaagcaatgacagcagcttatgttggaatcaaaatcatgccgacaggcggaatcaatccgaaaaatgtaagagaatacttagcttgtgacaaaatctttgcatgtggcggaagctggatggtaaaaggtgatatgattaaagcgggtgaattcgataaaatcgaagcaatgacaaaagaagcagttgaaatcgtaaaagaagtaagaggataagaatcgcagatttgcggatgagggagactttaacactgtgctagtggatggtgcagtgctaagaaataaaagatagaaattaacatgctataaatgaccccttttgccatgggtgaacatttagatagaaaaaaagggtgtggagaagtctgcatcctttttttctacaaagaaaggagcagatattatgaaaaaagattttgatttgctgtcactcggagaaattttgcttcgactttccccaccggataatgaacgaattgtgcgtggagaaacatttcagaaacaggtcgggggagcggaattaaatgtcgtatccggagctgccctgttgggccttagaaccggaatcatttccaaacttccggataattctttaggaatttatgcaaagaaccgtgtccgtttctgcggtgtcagcgatgactatctggtatatgataaagaggaagatgcaagacttggaatttatttctatgaaaatggtgcatatccaagaaaaccaagtgtcgtttatgacagaagacatgcttctttttgtaaaatcaatgaaacagaagtttcggattccatgtatgcaaatacagcctgtttccatacaagcggaattactctggcactttctgaaaatacaagagaagtagccattgatatgattaagaaatttaaggcacagggtgcactgatttcgtttgatgtaaacttcagaggaaatttatggaccggagaagaagcaaaagagtgtatcgaacgaatcctgccttatgttgatattttcttttgttcagaagatactgcccgcctgactttcttaaaagagggaaatgtaaaagagattatgaagagttttaccgaagagtatccgatttcaattgtggcatctactcagagaattgtacacagcccgaaagtgcatacctttggttcagtcatctacagtgcaaaagaagataaatactttgaagaagaaccataccgtgatattgaagttgtagaccgtatcggaagcggagatgcttatatttcaggtgttttatatggtttgctcggctgtggatttgactgtcagaaagccttggaatatggaaatgcaaccagttctgtaaagaatacgattcctggtgaccttccttcctgtgatttaaaagagattgaccgaattatccggaatcataaaaataccggaatccagcttgaaatggatcgataataaaaaataggggcatatactgatagaaaataagaatggagaaattttttatgcgtgtatgccagcttcgacaaaaagaagtgattaatatctgtacctgtaagagcctcggtgtgccgtttgaccttgagtttgatgaaaagactgggtgtgtgacagcaattattgttccgcttccggggaaaatctgtggatttttcgggccggtcagtgagtacgtgattccgttcgaatgtatcaaacaaattggggaagatattattctggtcgaaataaaagaagaaaagtttttaaaaaagagttagataaaagaaccctcggtattttgcagttacgcaccgagggatctttatcttttcacgaccgaagataatttttcatggattttaaggcatgtttttcaagccggctgacctgagcctgcgaaattccaatttcctgtgcgacttccatttgggttttcccctcataaaagcgcatttctatgatatttcgttcccttgtctcaagccggttcattgcttcttttagagagatatcctcaatccagtgttcttctttatttttcttatcactgatctggtccatgacatacaaggtgtcaccgccttcggtgtaaaccggttcatatagactgaccggactttgaatggcatcaagggcatagacgatatcctctttattgatgccgatttcactggcaatttcctgaactgttggttctcttaagttctgtttcatataatattcttttgcatggattgccttataggcggtatcacgcagggaacggctgacgcgtatggagttgttgtcccttaagtaacggcggatttcaccgataatcataggaacagcataagtagaaaagcgtacatttaatgtggtatcgaagttatcaattgctttcatcagaccgatacagccgatttgaaataaatcatccgcattttcattacttgcagagaagcgtttaattatacttaagaccagccttaaattccctttgatatataaatctcttgcttctgtgtcacccttttttatccgttcaaacagcatttctttttcggcattggtaaggacagggagttttgatgtatttacgccgcatatttcaactttattaagagccattgcaagaatcctccatttttagtttcatgtacgaatacatttataattagaatgattctcataagactgtcacaatatactgtaaaatggaaaatttcataaagttttagcccttgacaacgcataaagtgcgaaaaagattgacgatttacgcttttgtgtactatactttaggcaagcaaggcagtaaaggaggctgaaaatgatgaagtgccctttttgtaatcaggaaaatacacgtgtcatagattcaagaccggttccggataataattcgattcgcagacgcagacaatgtgatgaatgtcataaacgcttcaccacgtatgagaagatagagacgattcctcttacggtaattaaaaaagaccagagcagggaaacatatgatcggaccaaaatacaggatggaattatgcgtgcctgttataaacggccgatttcggtggaacagattgaacgcacgattgacgaaatagagacagagattttcaataaagaagaacgggaaattccaagtacggaaatcggagagattgtgatgaaccgcttaaaagaattagatgcggttacgtatgtccgttttgcctctgtctatcgggaatttaaagatgtgaatacctttatggatgaattaaagaagatgttaaagtaataagagaggactcaccgagcaccggtgagtccttatttgtctgtattattcttttttagtttctaaagtatccaaagtaacagagagaataagattaaaatgagcatcaaaacgtagtaaaaatattggatgtttgatttcttttggtggctgtcatatccaagtactccaaagacgaaaaagaggtaaagatataggagttgtttgcaaaggatgaaatcaagtttgaaaaacggataagacaaaaagacaaaaataccgagtacaataaataaaatagattttttcttcataatgaagactccgtttaaagtttttctcataggcagcctcctattaggtttaaaaaaatcagtaaaaaagaataatacagaataaataattgttaatttattatattttaacatattgactttggaaaatcaaaaaaatatttttgttaagagcacttttttcactataaagggcagttctgcttcttgcgctttgtatggtaaagtgataaaatctccataaatcaggatgcggatgaaaatgagaggagcagagacaagatgagaacatttaaaaaatcttcaaaattagaccatgtatgttatgacgtaagaggaccggttttagatgaagccaaccgtatgcaggccgatggaatcgatgttttaaaattaaacataggaaatccggcaccgtttggattttccgcaccggaagaagtcattacggatatgatttccacccttagaagtgcacagggatattccgattcccatggaatctttgctgcaagaaaggcaatcatgcagtatgcgcagacaaaaaatattccaaatgtgtcaatggaacatatttataccggaaatggtgtcagtgagctgattaatttagtgacacagggactgattgataatggagatgaaatcttagttccatctccggattatccgctctggaccggatgtgtgacccttgcaggtggaaaagcagtacattatatctgtgatgaacagtccgaatggtatccggatatcgaggatatgagaagtaaaatcacagataagacaaaggcgattgtcattatcaacccaaacaatccgaccggtgcagtttatccaaaagaagtgcttgaacagattgtggaacttgcaagagaacatgaactaatgattttctcagatgagatttatgacagactggtgatggatggaattgaacacacttccattgcttctttagcaccggatttattctgtattaccttaaatgggttgtcaaaatcccatatgattgcaggttttcgctgtggctggatgattttaagcggagcaaaggaaaaagcaaaagactatattgaaggtttaaatatgctttccaatatgcgtctgtgttccaatgttccggcacagtgcatcgttcagaccgcacttgggggacatcagagcgtgaaaaactatcttgttccaggtggaagaatctatgaacagagagaatttatttacaatgcaattaatgatattccgggcttgtcagcagtaaaaccaaaggcggccttttatatcttcccgaaaatggatacgaaaaagtttaacatcttagacgatgagaaatttgtgctggatttattaaaggagaaaaaagtactgcttacacatggaagaggatttaactgggcggagccagaccacttcaggattgtatatctgccgaatattgaacagttaaaggatgcgacaggaaagattgcagatttcctttccggatatcatcaacagatttaaacaaaaaaagggcttataggaattaaactataagccctttttttgttaggcgacaaaataaaaaatagaaataaatttcttaaaaaaccataaaatgggttgtaaaatgaaaaaaacagtgctaaattatattagtcgactaagtaaaaaggtggtgagatttcgtgaagtgcgaggaaatagatagtttacagggactgataatgcgcatgacacatttatactatggcaaagcgtatgcagcaatgaaagaattagatgttcatccaaggcagataccattgttgtttatactgcagaaaaaagaaggaatgagtcagagagaaatctgcgatgaaatgaagataaaaccgccaacggttgcggtttctatcaagcgaatggaaaaagcaggtttaattgagaaaatgccggatgaaaaagaccagagggttgtccggatttatgtaacagaaaaaggaaaatcgctgagtaagcagattgagaaagtagtcaaagaaagtgaagcaaaggtagtagaaggattttcagaagtagaaatttgtcttatgaagcggtttttgaagcaaatgatagcaaatatggaacaggaagaaagcaaaaaggagtgacacgaagattatgttaaaaatgtttcattacatgaaagaacgatggtattacgtggtaatgattattgttcttttatttgtgcaggcatattgtgacctttccctgccggattacacatccaaaattgtcaatgtgggtatccagcaaaaaggaattgaggatggagtgccggataccatccgaaaagagagtctggagcacctgcttttgtttttagatgaaaaggaaaaagcaaaagtagaagatgcctataccttaaaagatgatgtctataaaagaaatgatgtcacaaaagaggaacgagatgagttaaattcgattcttgcgattccgatgatggcagcaggaagtttagaggatgaagaaaaggcagcagaaatcaaaacacagatgggactgcccgaagagagtgatttatggcaggtattagaacaattaccgcaggaacagttagatgccatgaaagattctctgatagagaaaataaaagaaatgccggaatccattgtaacgcaggcagccgtacagtttgtacagacagagtatgaagcacagggaattgatgtagatgcgatgcagattcagtatctgatgacctctggacttaaaatgcttgcaatggcacttgtcattatgcttgcagccgtttctgttacatttttatcttcaagagtggcagcttttcttggacggaatcttagaaatggagtctatcggaaagttatttcattttccggtgaagagttaaatcatttctcaaccgcttctttgattacaagaagtaccaatgatattcagcaggttcagttagtatttgctatgatattcagaattgtactttatgccccaattcttggtgtgggtggtgtcttgaaagtcttacagaccgatgtttccatgacctggattcttggtgtggcagtcgtggcaattttaattttagttggatttctatttgcagttgcaatgccgaaatttaaaattttacagtaccgaattgatgaattaaatctggtttcaagagaaattttaaccggtctttctgttattcgtgcgttctcaagagagaaacatgaagaagaacgttttgaagaagttaatgaacgtctgacaaagacaaacctgtttgtaaatcgctgtatgacttttatgatgccggcaatgatgctgattatgaacggaattactgtattgattatctataatggttctcatgcagtagataatggaacaatgcaggtcggaaacatgatggcatttatgcagtatgcaatgcagattatcatgtcgtttttaatgattaccatgatgtcgattatgcttccgagagccagtgtatctgcaaaacgtatcaacgaaattatggagacaaaagtaagcattgaatctccggaaacagcaaaaattccggaaaataacaaaaaaggtgaagttcgttttgaacaggtaggatttgcttatcctggagcggaagaggaaacgctttcggatattaactttacagctcaaaaaggagaaaccgtagcatttatcggaagtaccggaagtggaaagagtaccttagttaacttaattccacgtttctttgatgtgacaagcggaaaaattctggtagatggagtggatatccgtgaaatgggactgcatgatttacgtgagcgaatcggctatgttccgcaaaaaggagtactgttttccggaacaattgattccaatatccgttatggaaaagaagatgcaacaaaagaagaggtcaatcgtgcagccgagattgcacaggcacaggaatttatcgggcaaaaagaaaaaggaatggaatctgaaattgcacagggtggaacgaatgtatccggtggacagaaacaaagactttctattgcaagagcaattgcaaaaaatccggaaatctatatttttgatgacagtttttcagcactggattataagaccgatgtggtgcttcgccgtgcattaaagaaagagacaaaagatgcaacgactttaattgttgcacagagaatcagtaccattttacatgcagataagattttggtattagacgaaggaaaaattgttggcgagggaactcataaagaacttttgaaaacctgtgaggtttatcagcagattgcaatgtcacagttgtcaaaggaggaattggaacatgagtaatacagcaggaagaggcagaggtccaatgggtcggagaagaggtatgtccggcgaaaaggcaaaggactttaaaggtgcaatgcttcggctcttaaaatatatggaacgttataaaatccgactgattttgatggtgatttttgcaatcggcggaaccgtatttaatattattggaccaaagattttaggtaaggcaacaacggaactgtattccggtctgatttcaaagattaacggcggaagcggaattgattttgataaaattataaaaattctcgttgttgtaatgtgtctgtatgtagtcagttcagtcttatcctttatccagggatttatcatgacaggcatttccaatgatgtgacttataatctcagaaaagatatttcaaagaaaatcaataaaattccaatgaaatattttgaaagcagaacacatggagaaatcctttcccgtattacaaacgatgtggatacgctgcagaccggaattaaccagagtgtaacccagcttattacatcaacaacaaccctgattggtgtactggttatgatgttaagcattaatgtgtggatgactttggcagcacttttgattctaccggtttcgatgtttattatcagcaaggtcatgaaacattcccagaaatacttccaggatcagcagaaatatcttggtgaagtaaatggacaggttgaagaaatttatagcggacatactgtagtaaaagcatttaacaaagaagatgacgtcatcaatgaatttgaaaagaccaatgagaaattgtacagttctgcatggcgttctcagtttttttccggaattatgatgccgattatgcagtttgtgggaaatcttggttatgttatggttgctctgcttggcggctttatggttattaaaaataaaattgaagtcggtgatgtgcaggcatttttccagtatatccgaaacttcacccagccaattcagcagattgcgcaggttacgaatatgcttcagtcttcagcagcagcatcggagcgtgtgtttgaatttttggatgtggaagaagaggaccagatggcagaaaatccagtgtctgtagaccagatagagggaaatgtcagttttgagcatatttcctttggctatgatccatcaaagattatcgtacatgattttaatgccgatgtaaaagccggacagaaagttgcaattgtaggaccgaccggagccggaaagacaacgatgattaaacttttgatgcgtttttatgatgtcaattccggggaaatctgtattgatggtcataatgtaaaagattttaaccgtatggaacttcgtgaaatgtttggtatggtactgcaggatacctggctgttccacggaacaattatggaaaatatccgttatggacgcttagatgcaacagatgaagaagtcattgcggcagcaaaagcagcccatgcccatcattttattatgtctcagccaggtggttatcagatggaattaaatgaagagaccagtaatatttcccagggtcagaaacagcttttgacaattgcaagagcgatcttagcggacaataagattatgattctggacgaagcaacttcttccgtcgataccagaacagaagagcgaattcagaaagcaatggataatctgatgaaaggacgaaccagttttgttattgctcacagactttccacgattcgtgatgccgacttaattctggttatgaaagacggagatatcattgaacaggggactcatgaatcccttcttgccaagaatggcttctatgcaaatctttataacagccagtttgaaaagatggaaacagtttaaagtgtaaaactttaaattactaaaatattttttgcaaaatgggttgacaaacgataaaaaagtcagtattatttggttagattaattaagagaggttttaccatgatgaagaatttattgaatgtatggacaaaagatttttattttggttatctgggttatttttataatgcaggtcttttgtgctatggtaaagcatccgtcaatcaattctgatttcaaagataccgataacagaattttaaccggtgtttgccttagcaggtgaacatcggtttttggttttatgagataaaatcttataaaaaaattcattcaatccaaaggagaaaaagtcatgattattgttttaaagaaagatgcagaagaagcgaaagtggaaaaattaaaagagaatttggtgaacagaggattaaaacttcatttatcacagggcgaagataccacaattattggtctggttggagacactacagagattgaaccggagcagttacaggcatttgacgtagtagaaaccgtaaagagaatcaaagaaccttacaaaaaagcaaaccgcagtatgcatccacaggacagtgtgattgatatctgtggaaagaaattcggtggaaatcattttcaggtgattgcaggtccgtgttccgttgagaccagagaacagatggttgaagtggcagaagatgtaaaggcatccggtgcaggtcttttaagaggtggtgcattcaaaccgagaacttccccatactctttccagggactgggcagtgaaggattaaaactgcttttagaagcaaaaaaagcaaccggacttccaattgtgacagagattatgagtgcagcacatctggatttattcgatgatgtagatgtgattcaggttggtgcaagaaatatgcagaactttgaactgttaaaagaacttggaaagataaataaaccgattttgttaaagcgtggcatgtcaagcaccatagatgaacttttaatgagtgcagagtacatcatggcaggtggaaacgaacaggttattttatgtgaaagaggaatccgtacctttgagacttccatgagaaacacactggacatttcagcagttccgatgttaaaatcaaagacacatcttccggtgattgtagacccaagtcatgcagcaggaatccgttttatggtagagccgcttaccatggcagcaatcgcagcaggtgcagatggtgttatgattgaagttcacaataatccggaaaaagcattatgtgatggtatgcagtcactgacaccacaggcatttgatgatgtgatgaaaaaagtgaagaaaaccacagagttttttggaaaggtaatgtaataacatgaagtcattagtactggcggagaaaccatcggttgcaagagatattgcaagagtattaggctgcagtaaaaaactaaatggggcaatcgaaggaaaccgctatgttgtcacctgggcgttaggacatcttgtgacacttgcagacccagaggaatacgacaagaaatataaagaatggaagctggaagaccttccgatgatgccgaaaaagatggaacttgtagtaattaaacagacggcaaagcagtatcatgcagtaaaaacacagctttatcgaaaagatgtgaatgaaattattattgcaacggacgcaggcagagagggagaattagtagcacgctggatattggaaaaatccggatgtagaaaaccaatcaaacggctttggatttcctctgttacagacaaggcaatcaaggcaggattttcttctttgaaagacggcagggagtatgatacattatattcagcagcctgggcaagagcagaggcagactggttggttggaatcaatgcaaccagagcactgacctgtaagtacaatgcccaattgtcctgtggaagagttcagacaccgacacttgcaatgattgaaaaaagagaagaagaaatccgttcctttaagccggagacgtattatggaatcaatctcatggcagagggaatccggtttacctggcaggataaaaaaagtggttctgcccgctcattttcaaaagagagaatcgaaacactcaaacaaaaaatgcaaggcgctccccttttcataaaagaagtagagaagaaagcaaaaaaaacttatgcaccggcactttatgatttgactgaactgcaaagagatgcgaataaaaaatttggattttctgcaaaagagacgttaaatatcatgcagaggctctatgaaaatcataagatactgacctatccaagaacagattccagatatttaagttccgatgtcattggaacattaaaggaacgcttaaaagcatgtgcagtcggtccatataaaaagatggcaggaagtctttcaatgaagccggtcaaggcaaataaatcttttgtggatgataaaaaagtaagcgaccatcatgcaattattccaaccgaacagtttgtacagttagaacatctgacaaatgaagaacgaaaaatttatgatctggttgtcagaagatttctggcagttttgtatccgccgtttgaatacgaacagacaacagtaaaagcaggctgtgaggaagaagaatttcttgcgaaaggaaagattgtcttaaaagaaggctggaaggaggcttatgagggaagctggtcagatgaagaggatgaggaacaaaaaggagagtctgctttaagagaacagaaacttccgaatctggaaaaaggcatgcagttttcgaataatattcgaattgaaattataacagggacgacacgtccaccggcacattttaatgaagcgacactgctttcagcgatggaaaatccggtgcgctacatggaaagccgggatgcaaagacagttaagactttaggagaaaccggaggacttggaacggtagcaaccagagcagatattattgataaactgtttcattcctttttgatggaaaagcgtggaaaagaaatttttattacctcaaagggacgacagcttttaaaattggttccggaagatttgaaaaaaccggaactgacggctgactgggagaataaactttctaagattgcagagggaaaattaaaggataaaatctttctttcagaaatccgcatttatgcacaggaattgaccaaagagattaaaacgggagatggaaccttccgccatgataatcttacaaacacaaaatgtccggtatgtggaaagcgtatgcttgcagtcaatggaaaaaacagtaaacttttggtatgtcaggacagagaatgtggacatagagaaacaatttcccgtacgtcgaatgcaagatgtccaaaatgtcataaaaagatggaattatatgtaaaaggcaaagaagatacctttatctgcagttgtggttataaagaaaaactgtcttcttttacagcaaggcggcagaaagaaggcgcgggagtcagtaaaaaagatgtccagcgttatctgaacaaacagaaaaaagaggcagaagaaccaattaattctgcatttgccgatgcttttgcaaaattaaaattgtaaatataaaaaaaagtttagaaactgttcataaaaatatttcttgtgaatcccccttttcttatggtaaaatgtcactatgctaaagtgaaaaaataagaaaagggggattctgctatgggattcaatatgaaagtaacaccggaaatcgaggctcttacaaaagtttgcgaagaaaacagtaaaatggatgtatctctttatggaaaatatgatgtaaagagaggtctgcgtgatatcaatgggaaaggtgttcttgcaggtctgacacaggtttcaaacatcgtttcgagtaaaactatagatggaaaaagtgttccttgtgatggggagttatactacagaggaattaatataaaagaccttaccaatggttttttaaaagaaaatcgttttggatttgaagagacaacctatttattgttatttggtgtacttccaacagaagagcagttaaaagatttctgcaaaatacttggaaatcagagaagtctgccgagaaatttcgtacgagatgtcatcatgaaagctccaagtaaagatatgatgaataccttgtcaagaagtgtgctgacgttatattcctatgattcgaatccggaagatatttctcttccgaacgtgctgcgtcagtgtatcaatcttatcagtattttcccaatgttatccgtttatggctatcaggcacatagacattataatcaaaataaaagtttatatattcataatccgaagaaagaattatcaactgctgaaaatattttgcgtatgttacggtcggataaaaaatatactccgcttgaggcaaagattctggatttggcactggtacttcacatggagcatggaggtggtaacaactctacgtttacaactcatgttgtttcttcctctggtacagatacctattcagccattgcagcagcacttggttctttaaaaggaccgaaacatggcggtgcaaacattaaagtagtcagcatgtttgacgatatgaagaagcatgttcacgattggaaagatgaagaggaagtttctgcttatcttcgaaaactgcttcataaagaagcatttgataagcgtggtctgatttatggaatgggacatgcggtttattcgatttctgatccgcgtgcacggattttcaagcagtttgtgaaacagttagccgatgaaaaaggaagacagaaagattatcgtctgtatgaaatggtagagcgtcttgcaccggtgattattgctgaagaacgtcatatttataaaggtgtcagtgcaaatgtcgatttttacagtggatttgtttacagcatgttggaacttccccttgaactgtatacaccaatgtttgcgattgcgcgtattgtcggctggagtgcgcaccgaatggaagaactgattaacacggataagattattcgtccggcatataaaaatgtattagaagaacaggcttatattgctttggaagaaagataattgacaaaaaacgagatttccgttaacatcgggtatgaatacacaacagaaatgaggaaaataaaatgtttcgtaccttttttccggatgaatatctggactctacttatgagattgattttgaaaaattgtatcaggacggttaccgtggattgatttttgatattgataatacgttagttcgtcatggggaaccggcagatgaacgtgcagttgcattatttaagcgcttaaagaaaatcggatttgactgttgtctgctttccaataatcagtatgagagggtttcttcttttaataaagaggtgcaggtgcattttattgaagatgcacataagccatcgaccaagaattatatcaaggcaatggagctgatgaaaacagaccgttccaatacgatttttgttggagaccagttgttcacagatgtatatggggcaaaaagaaccggaattcgcaacattttggtaaaaccaattcatccaaaagaagagattcagattgtgtttaaacgcaaattagagaaaattgtgctttatttctacgagaaagagaaaagaaagcaaaaaaatggttgaaaaattaagtcgggtattatacaatgaagtacagtggaaaaaacgattttattttccaatggaagaaggccacgaaaatcaagtggtaaacaaataaaatctaggaaaggaaaagctatttagatgaaaacctatatctaatcaactaaaaatgaagttataggtgtgtaccgatggctagtcgggaatttacgactgtggagtgtacaagaatttacgagtagatagatattttttatatcatcaaaagtatacacgatgaagcagtaactacaaatcgtgagattgtagcgaatcatctagcatatacgcatttgtatatgtttttagtagcaggagtattcattatgatatcagcaggcgattttaaaaacggtcttactctggaaattgacggaaacgtagtacagattatggaattccagcatgtaaaaccaggtaaaggtgcagctttcgtaagaacaaaattaaaaaacgtaatcaacggtggtgtggtagaaaaaactttcagaccaactgaaaaattcccacaggctcgtattgaccgtgtagacatgcagtatttatacaatgatggtgatttatactacttcatgaacaatgaaacttatgaccagattgcaatcgacaacgaaacagttggagattctctgaaatttgtaaaagaaaacgaagttgtaaaagtatgttcctacaatggaagcgtatttgcaatcgaagctccgttattcgtagaattagagattacagaaacagaaccgggattcaaaggtgatacagcacagggcgctacaaaacctgcaatcgtagaaacaggcgctactgtttatgtacctctgttcgtagatcagggagacagaatcaaaatcgatacaagaactggagagtatttatccagagtataatgattgaaagcactcagccggaagattacttccggctgtttttttctttaaagagagagttcctgtttttttaagtcatagtaatagacatgattggaaagcacttcttcttttgcaacctgtgtggaattgacttcgacaaccatttcctctaactccggtttggaataaactccaaagtcaggaacgagaatacattcatgtacgctgcttggcagaacaaagaaattacagccaagaagtgctgaaatatgagaaagtacgtgaggatagagaagagcagctgcgccaaaatacgtttcctgattggttaaaatatacatggagtttggggaaaattcggagggaagaagtgattcatcattagagagctcgcgaatcagagcatccatttctttaaaacaaaaaggaagcttgcggcaggtattgagtctggcgtcacgaattaaatcatctgtggaaacattccatgcggtaaggttggaattgtggattagaaagcttccgttttgaagatttggggcggtaactttacagtaaaagacaattgccaaatcgagataagggatatggggaattttgtttaagagagaacggttcatttcgtaattgatgagtttatagcagacatgcgtgcgcattttttgataatcatgaacttcatcagtcagtgcaaacgaagcctccggctgatgctgttggttgagttcaagaatccgcctggcaatgcgctcaatggaaatgccttgacaaaaccagggataaaaatcgtctaaataaaaagtaggagcaatttgacctccttttttcataatgataacagcatctgcacagcttccgttatttttgtcaatacagtgtaaagaaaccgactgctcgggatctgccaaatcctgaattgcaagtaacagttcttctttaaagagattgtagtccatagtatgacctcctgagattaaaatataaaattataatgtgaaataaaatataggaattttttcggagaagttccgaaaagaaattagaaatgtatttcaataatataccatgagtgataggaaactgcaagcggtcatttattaaaaaagtctaaaatcgaaaatcaggagggtttacaaccaatccgttttatgataagatattttacgtcagtaagcactcgtagctcaggggatagagcagtggtttccggtaccacgtgtcgggggttcgaatccctccgggtgtgttttttcttttttttagagaaaaaagcagagaataagggtaagagataaaggaggatgctatgttagacaacttcagagaatggctgtcagataatctgagatatattcttctgggtttggctattttagttgttctgctcgtcttattttttggagtccgtgcagtgacaggacttgttacttcaaaggagaaaggaaacacaacggaaaagacacaggttgtagattctaagaatgataacacagaagcaaaagatgagagcaagaacaatgacaaaaaagaagaaacctcttctttagaaaaaaatgcgtaccctgaagtaaattcattaatcaattcgttttatgaggcatggggtcgaaaagacatagagcagatgaaacagctcacagataatttagatgcagccgatgaagcgaaggttacaaattcgacttatattgaaagttataatgatattactgtttatacgaagccgggtttaacggatgatagttatgttgtgtatgcttcttataaattaaaatttacagatattaaggcagaagcaccagggctttcccagctatatgtcatgaaaaatgaagacggttcttatattatccataatgacagcagtgatgaaaaaattaatgcctatcttcagaaagtaacacaagatgaagatgtacagaaactggtttcacaggtggaggatgatttgaattcggcaattgaatcggatgaagatttaaaagcatttgaagaacagcttggtcaggacagtaattcttcagcaagagcagaagaaggtgcaacacttacggtacaggaagactgcaatttccgtgcggaagcggataccgaagcagaaattcttgatgtgattccgggaggaacagaggtaacaaaggttgcagatggtccggaaggatggatagaagtagaatataataatgagaaaggttttgtttcgcaggatcttttaagataacaaaaaacccagcttataaaagctgggattttttgttattattcaggacttataattatcggagtgcaccataggcaccgccattttccagattgattccttttgcggcagccagttcactgactgttaccatctggaatccttttgcttttaaggcagggacaatcatatcaacggcgtctgctgtcggaccatgaatatcatgcattaagataacatccccatcctgtgcagtcattgccgcttcgtaggtactctgggcatttttggtcttccagtcgagtgtatcaatagaccataaaatcataggaaatccgattacggattttactgtagaattataagaaccataaggaggacggactaaagaagcaccgtgtccgacaagcgcatttaatttgtcgtttgtagaacttacctcgttttgaatcgctgtcgtatcaagggttgccaaatccttatggtcaaaggtatggtttgcaagttcacagcctagactttccatttttttaacagcgtccggatagtttgggatatttgttccaagcatgaagaaggtcgcttttgcaccgtttgctgccagtgtatttaaaatacgttcggtatactgaccaggaccatcatcaaaggtgagtgcaaccattggaccggagcccgttgtcttaacagcagtggatttgccatcccatactccattttcgtcaaaggtatattttttgttgtcaataatcagttcaccggtagccattgtgccatcctctttcagataataccatttggagtcaagttgtaaccatccggtttttggaagtccgttttcatccagatagtaccagctgttatcgtacttataccagtcggaagttaccagtgtaccatcagaatttaagaagtaagtctggttattaacggttatctttccggtcataatagttccatcttctccaagatagtaggtttttccgtctttttcttcccaggaattggttatcatgtagccatctccgtcaaggcagtaggtttttccgttatctgtaatccaaccaatcatcatcactccgtcctcacggaaataataccatttgtcgttgatactgcgccatccggttgaaatcgcaccggaagtatttaaatagtaccagtttccgtcttgctgaatccagcagttagaagccatggaaccatcatcattcatataatagctggtgccgtctgcttctacccatccggtagccataatgccctggtcatttaaacagtaccatttgccattgtcacttagccagccggttttaggtgttccgtcgctgtttaaataataccatttgccgtcgtctttaacccatccggaagcaggtgttccgtttgctgtcagatagtaagtagagcctttatccgtaatccatccggattttacatatccgttttcgtcaaagcagtaacggactccgtcaatctcacgccaggtatttttaattaataccccatcatgatagacatacttacgaccattctcatcgtatacccagtggtcctccagcagagcttctttcttatcctgataagtatcgagggctgtttttacagctgcgaaaatatatttcggtgcaaaaatcaaaatcactccgacaatacaggtaagcaggatgatacccacagttttctttgagtttttcataatgtgtttttacccctttgtaattcaggcattcttcttttagcaacgcaggcacagctctacaattgcccgcagattttgttttgaaaaagtgtttttcaaataaaaaaagaagaatacgtttctatgtacctgtctattatacgcttgcactcttggatttggcaagtaagatttcaagaggagttctttttgggcttttctttgctttgcgggagaagatatggtatactttttctattgcgataaggatggatacgcaagaatagaaaaaggagtaaagatgcgtttaaacaaatatttaagtgatgcaggagtctgttccagacgagaggcagaccgtctggtggaggcaggaagaatcacaataaacggcgaaactgcccggatgggaatgcaggtgtcagatgaaacggaaatctgcattgatggaaagaaaatcatccgtgaagaaaagaaagtattattagcatttcataaaccgcgtggaattgaatgtacagcaaatccaaatgtaaaaaagaatgtgatttcttatattaattatccaattcggatatattatataggaaggttggataaagactcagaagggctgcttttgctgacgaatcagggagaactcgtcaataaaatgatgcgttccggcaatcagcatgaaaaagaatatgttgtgacagtaaataagccggttacgaaagaatttatcaaaaaaatgcaggatggtgttccgattttaggaaccaaaaccagaaagtgccgtgtcattcaaacaggagaaaaaagttttcgtattatcttaacgcagggtttaaaccgacagatacgaagaatgtgtcagtatctcggatatgaagtaaaacgcttaaagcggattcgggtaatgaatattgaactgggtgatttaccggttggatcgtatcgggaagtgacggcacaggaaatgaaaacattgcaggaaatgattaaagactcttcggaaacaaccgtaatcaaaaaagaaagggggaagaaatgtgaaccggacagaaagaatgaaggaactcgtcgaattgttaaataaggcaggaagagcttattatcaagaggatagagaaattataagcaattatgagtatgataagctttatgacgagttagaagcactggaagaagaaaccggaattacgcttgcgggaagcccgacggtttcagttggctatgaagcagtcaatgcgcttcccaaagaaacgcatgagacaccgatgctttctttggataagacaaaagagatagaagtgctgaaaaactttgtgggaaatcaaaaaacagtgctttcctggaagatggatggtctgacgattgtactgacgtatcaggacggaaaattaaaaaaagcggtcactcgtggaaatggaatagtgggagaagttatcaccaacaatgcaaaagtgtttaagaatgtgccgcttcagattgcctatcaaggagaactgatattgagaggggaagcaattatctcttattctgattttgaaaaaatcaataaacagattgaagatgtagatgcaaagtataaaaatccaagaaatctgtgcagtggttccgtgcgtcagttaaataatgagattacagcaaaacgaaatgtatacttttatgcgttttctctggttcgtgcagaaggagtgaattttaacaattcaagagcgtgtcagtttgaatggctcaaaacgcaggggtttgatattgtggaatatcgtatggtggacagcaaaaatctggaagaaacaatacagtatttttcagataaaatttccacaaatgattttccgtccgatggattggtggcattatacgatgatattgcctatggagattctctcggaagtaccgcaaagtttccaagaaatgcttttgcttttaaatggaaagatgaaatccgtgagacaacgttaaaggaaattgagtggagcccatcaagaaccggactgattaatccggtggccatttttgagccggttgaactggagggaacaacggtaagccgtgcaagtgtgcataatatcagtattttaaaagaactggaacttggaattggagaccgtattgaagtctataaggcaaatatgattattccgcagattgcagagaatcttacaagaagcagaaatttaaccattcctgactcctgtccggtctgcaaagagccgacaaagatacaaaaaagtaatgacgtggaggtactaatctgtacaaatccggagtgtcaggcaaaaaaaatcaagtcctttacgttatttgtgagtcgggatgcaatgaatattgacgggttatcagaggcaacacttgaaaaatttatcttaaatggatttatcaaagaatttggtgacatttatgaattggaacattataaagatgcgattatagagatggatggatttggtgaaaaatcgtatgaaaatctgattgagaacatcaaaaaatcttctcatacaacgcttccaaggctggtctatgcgcttgggattgcaaatattggagttgcaaatgcaaaggtgctttgcaagaaatttgattatgacctgcaaaaactgatgcaggcggatgaagaaactatcagtcagatagagggaattggttcagtcattgcaaaaagcgtgacggattattttaaaaatgaaaaaaatcagagaaagttagaacacttgctgacttatttgacgtttgaagaaatgaaaatagaaacgggaaatccgctgtcgggaaaacagtttgtcataacaggaagcgtgaaccaatttgaaaaccgaagtgcaatgaaagaatttattgaaaataggggcggaaaggtaaccggaagtgtcagcaagaaaacggattatctgattaacaatgacacagaatcctcttcatctaaaaataaaaaggcgaaagagctgggaatcccgattctttcggaagaagattttttaaaacttgcagaatcggtacaatagagaaagaaggcagacttgatttatgaaaaaagaatggcagataaaaggaattagagggattaaaacgattatttttggtcgtaccctgattgtggctgttgcatttatcattcagtttttgcttcttggtgtcacttttttctgggcgaaagagtatagcgggattgtatatgccggcttcagcgttttaggtttaattgccctgctccatatttttaacagtcggggcaatccggattttaagctggtgtggatgcttccgcttttactttttccggtttttggagcactgttttatacctatattatgatacagcctggaacaaaaatgatttatcaaaggcttcgtgtactgggtgaaaaatcaaaagtctatttaaaacaggacgagaaaacatttgaaacgttaaaagaagaaaatccacagatggggcggatggcagattatctcctggaacatgggaattgtccggtttatcaaaatacgacgattcaatattttccactaggagatgaccagtttccggaattgttaaaacagcttaagaaagcagaaaaatttattttcctggaatattttattttagaagaaggatatatgtgggagtctgtgcttgaaattttacaggaaaaagtgaaggccggagtagaagtacgtgttatgtatgatggaatgtgtgaactgacattacttccaaatttttatccaaaattactgaaaaaatatggaatccagtgcaaaatgtttgcaccaattcgtccggtcttttccagtcattataataaccgcgaccacagaaaaattgttgtgattgatggaaaagtggcttttacgggaggaacaaatctcgcagacgaatacattaataaaaaagaacgatttggtcactggaaagataccgcagtaatgataaccggagatgccgtacagaaatttacctgtatgtttttggaaatgtggcatacaacagaaaaaaaagaaccggattatgaatcgtatctgacaccaaaatcaatattaaaggaaaaagatggttacgtgattccttatgatgtcatgccttatggaacagaacgtgtcggaaaacagatttatctggatattttaaatactgcctgccagtatgtacatattatgacaccgtatctgattttagattatgaaatgattagtgcactgacctatgcggcaaagcgtggagtagaagtttcaattattatgccgcatattccggataagcaatatgcatttgcacttgctaagacgtattataatgaactattagaggcaggtgtgaaaatttcggaatataaaccaggatttgtgcatgcaaagatatttgtttctgataacaagaaagcagtcgtaggaactgtgaatctggattatcgaagtttttatcatcattttgaatgtggtgtctttttctacgagaattctgaaatccaaaaaattgaagaagactttgaagagacaatgaaaaagtgtatccatatatcattagctgattataaaaaactaaaacttgcaacaaggatagagggaaaagtccttcgtctgattgcccctcttatgtaaaacagaaaggataaaaaaacaatgccaattaaaatacaaagtgatttacctgtaaaagagattctggagaaagagaatattttcgtgatggatgaaaagcgtgcctcacatcaggatatccgtccgattcaaattttaattttaaatctgatgccgttaaaagaagatacggaacttcagctgcttcgttccttgtcaaatactccgcttcaggtggatgtctcttttatgatggtggcaacccatgaggcaaaaaatacagcgaccagccatttgaataagttttatgaaacattttctgaagtaaaacacagaaaatttgatggaatgattattaccggtgcaccggtggaacagatggagtttgaagaggtagattattgggaagaattaacacagattatggattggacaaaaaccaatgtcacatctacaatctatctgtgctggggagcacaggcaggattatattaccattatggtctgaaaaagagactgatggataaaaaagtctttggattgtttagacatcgtgtagagaatcgaaagattccgctggttcggggatttgatgacgagttttgggcaccacattcccgtcacacagaggttccggcagcagagattcatgcctgtgaagcattaactgtacttgcagaatcggacgaagcaggagtatttttatgcatggcagaagatggacgtcagattttcgtgatgggacatccggaatatgaccgtgttactctggacggagaatataaaagagataagagtaaagggctggatattgagattccgaagaactattatccggaggataatccggaaaacagaccattgcttttatggcgttctcatgcaaacaatttatacacaaactggttgaattattacgtataccagacgactccgtattcttttattaatactgctgaaattattggaaaataatagaagaaaaaaagaacgatttctatattgacgtcagaatgaactttggatataataaacagcggaatttaagcggtacagcgttgccaaacaaaagcgtagaagcgtaagcctgtaaaaaatgatgggtcgaaattgcgaaaggagaaaaaaaggtttgggaaaagaaaaaaaacaagtagagtacacgagtgagtatgaactggaaggacgaattccactggggagagccatacttcttggtatgcagcatgtgcttgcaatgtttgtcggaaatctgacgccgattctgattatcggaggaatgtgtggactggcagatgcgggactgatgcgtccggttttgcaaaatgcaatgttaattgctggtattgttacgttaatccagctttggacgataggaccggttggctcaagattaccgattgtaatgggaacaagttcagggtttatcggtgtttcaaaaggaattgttgcttcatgcggcggaggtgttttagcttatggagcgattatgggagcctgtttgattggcggtctgatggaaggtgttctgggattcttcttaaaaccattaagaaagtttttcccggcattggtaaccggtacagttgtaacagcgattgggctttctcttatcagtgttggaattaattcctttggtggaggaaattcaaatggagactttggctctattccgaacttatttgttggtactttggttttggtttctgttattttatttaagcactttacaaaaggaatgacaagttctgcatctattctaatgggaattatcgtaggttatattgcctgtgtgattatggcattggtgcttccaactacatataccgatgcagagggggttgtgcagacctgttcctgggtgattgactggtctaaagtggcagatgcatcctggtttgaaattccgaaatttatgccggttaaaatgacgtttgatttaagagcgattattccgtatttaatcatgtttattgtaactgcagttgaaacaatcggagatatttcaggtgtcgcagaaggcggattagaccgtgaggcaacggataaagaattatccggtggtgttgtatgtgatggttttggttcttcatttggttctttatttggtgtacttccaaatacctcatttagccagaatgttggtcttgtaggtatgacaaagattgtcaatctgtttgcaatctcaatgggagccatctttttgattatctgcggtcttgtgccaaaggttgcagctttagtggaaattatgccacagtctgtacttggcggagcggcagttatgatgttttcctctattgtagtaagtggtattaaactgcttacaaaagatggagttgattcccgtgcagtaactattatgtcagttgcacttggatttggctatggacttggttcaacagcagatgtattaaatcagcttccatcctgggtcagctatgtatttggcggttccggtattgttccggcagcggttgttgcaatcgtattaaatattttaattccggtaggaacagatccatttgaaaagaaagaagaaaaagcggaataaaaaaataaaaataaaaatgctcagagccgttatgactctgagcatttttatttttatttagttgtcttcttcggtcattgtatagacagattgacgtttctttgccatttcatcactttcaagatattcatcataagttgtaatcttgtcgataagaattccgtttggcataatctccatgatacggtttgcagttgtctgtacaatctggtggtcatgggatgcaaataagataacaccaggaaatttaatcataccattatttaaggcagtaatggattccatgtccagatggttggtcggctcatcaaagagcagtacgtttgcaccggaaatcatcatcttagataagagacatcttactttttcaccaccggaaagaatacgtacttttttcacaccatcttcaccagggaagagcatacgtccaaggaaaccacgaacataagttgcgtctttgatttcagaatactgggtcagccagtctgcgatggttaagtcattgtcaaactcaagtgtgttgtctttcgggaagtaagactgggaagtagtaacgccccatttataagtaccttcatccggctccatttctcccatcagaattttaaagagaacagtttttgcctgttcgtttccaccgacaaaagcaactttgtcttcgcgtccgagggtaaaagtcagattatcgaggacttttactccatcgactgtcttggaaagaccttctaccattaatacttcgtttccgatttcacggtttgggcggaaatcaatgtaagggtatttacggctggatggacgcatttcatcaagctgaattttttcgagcgcacgttttctggaagtcgcctgtttggattttgacgcatttgcagagaaacgggaaataaattcctgaagttctttgatcttttcttctttcttacggtttgcttctttcatctgtttaattaagagctggctggattcataccagaaatcatagttacctgcgtataactggatttttccgtaatcaatatcagcggtatgagtacatactttatttaaaaaataacggtcatgggatacaacaataaccgtattttcaaagttgattaagaattcttcgagccattcgattgcgtttaagtctaagtggttggtcggctcgtcgagaagcagaatatcaggatttccaaataatgcctgtgcaagcagaactttgactttctggcttcctgttaaatctcccataatagcgtaatgaatttcagtctcgattccaagtccatttaataactgggcagcatcggattctgcttcccatccgttcatttctgcaaactcaccttcaagttcgctggcacggataccatcttcatcagaaaaatcttcttttgcgtagatggcttctttttctttcatgatttcataaagacgcttgttacccataattacagtatccagtaccggataagcgtcgtatttaaaatggtcctgctgaaggaaagagagacgctgaccaggagtgattgtgatatcaccacttgtagtttcgagctgaccggagaggattttcaggaatgtagattttcctgctccattggcaccaatcagaccatagcagtttccctcggtaaatttaatattaacatcttcaaacagtgctttttttccaattctcaaagtaacattatttgctgcaatcatgtttttacctcacttatttctatatacaaactgtgtgtgcataatctcttcctattttacagtaaaatagggaatttgcaagcatttctttcaaaatacttgataaattaagtatacataggtataatgatggcacttagagcatgtcgaatgatgacaggaactaaatgagtaaaaattttttatagataaaatgtactctcggagttcttattgtatttgcttttgtggctgatttttcgtcggatgcacccgaattttatcaacatatgcgccgcatatctgacaaaaaatcttctcacgaaatcaagtacagaaatcaagcacagaaaggttctgaaagtacgttaaagaagaagggagaagctatgctgattaccagagaatgtgattatgcagtacgtattgtcagagcactggcaggaggtcagaaaatctgtgtgacacagatttgtgaagaagaagtgttgacacctgcttttgtatataagattttaaaaaagatggaaaaagccgaacttgtgaaaagttatcgtggcagtaatggaggttatgccttaaataaaggaattgatgaaattactttaatggatatttaccgtgcagttgagccggaatttttcatgattgaatgtatgaatccagataagccgtgtgttcgaaatcagggagatggctgcaaagtacataaagaattatgcagaattcagaaagtactgacaagagagttaagtgctaagacaattaaggaaattatagaagcataaaaatgtttttttgagaaaacattgcattttcttttcttataaaaatagacataatttgtaaatcgtgatataattattgacagacttcggagagcgaagtgaacattgtttaaagttgtaacaatttacaaggaggaaaaaacaaatggctagaaagatgaaaaccatggatggtaaccatgcagcagctcatgcttcttatgcattttctgacgttgcagcaatttacccaatcaccccatcatccgttatggcagaagctacagacgaatgggcaacacagggaagaaaaaatatttttggacaggaagttcaggttacagaaatgcagtctgaagcaggtgcagcaggtgctgtacacggttcccttgcagcaggtgccctgactacaacatatacagcatcacagggtcttctgttgatgattccaaacctttacaaaatcgctggtgagcagttaccgggtgtattcaacgtatcagctcgtgctcttgcaagccacgcactttctattttcggtgatcattccgacgtatacgcatgtcgtcagacaggatgcgctatgctttgtgaatcttctgtacaggaagttatggacttaacaccagttgcacatttagcagcaatcaaaggtaaagttccattcatcaacttcttcgacggattccgtacatctcatgaaattcagaaaattgaaacatgggattatgaagatttaaaagatatggcagatatggatgcaatcgatgagttccgtagaaatgctctgaatccaaatcacccatgtcagagaggttcagctcagaacccggatatcttcttccaggcaagagaagcatgtaacccatactacgatgctcttccggcaatcgtacaggaatacatgaacaaagtaaatgaaaaacttggcacagattacaaactgttcaactactatggtgcagctgacgcagaacacgtaatcatcgctatgggttctgttaatgatacaatcgaagaaacaatcgattacttaacagcagctggacagaaagtcggtgttgttaaagttcgtctgtacagaccattcagcgcagcagctttagttgaagctattccggaaactgtaaaacagatttctgtattagatagaacaaaagaaccaggtgcacttggcgagcctctgtatctggacgtagttgcagcattaaaaggaacaaaattcgatgcagttccgattttcacaggtcgttacggtttaggttctaaagatactacaccggcacagattgttgctgtatacaataacacagaaaagaaaaaattcacaatcggtatcgttgatgatgttacacatctttctctggaaacaggtgctgcacttgttacaactccggaaggaacaatcaactgtaagttctggggtctgggtgcagatggtactgtaggtgctaacaagaactccatcaagattatcggtgataatacagatatgtacgctcaggcttactttgattatgactcaaagaaatccggcggtgttacaatgtctcaccttcgttttggtaaaaaaccaatcaaatctacttacctgattcaccaggcaaactttgttgcttgtcataatccttcttatgtaagaaaatacaacatggttcaggaattagtagatggtggtacattcctgttaaactgcccatgggatatggaaggacttgaaaaacatcttccaggacaggtaaaagcgtttatcgcaaaccacaacatcaaattctatgtaattgatggtgttaaaatcggtattgaaacaggtatgggtcctacacgtatcaatacaattcttcagtctgcattcttcaaactggctgcaatcattccggaagaacaggctattgatttaatgaaagctgctgcaaaagctacttacggacgtaagggtgatgatgtagttgctaagaactgggctgctatcgatgaaggtgcaaaacagatcgttgaagttactgttccggaaagctggaaaacagcagcagacgaaggtcttgacacaacacatgcagaacagggaagaaaagaagttatcgacttcgttaacaatattcagtctaaagttactgctcaggaaggtaatacactgccagtatctgcattcaaagattatgtagatggtacaacaccatccggaacatccgcttacgaaaaacgtggtatcgcagttaacgttcctgtatggaatccggaaaactgtatccagtgtaaccgttgttcttatgtctgcccgcacgcagttatccgtccggtagctctgacagaagaagaagcagcaaatgctcctcagacacttgaaatgactggattaaaacagtacaaatttgctatcgcagtatccgctcttgactgtacaggatgtggttcttgtgtaaatgtctgcccaggtaaaaaaggtgcaaaagcacttgctatggaaaacatggaagcaaatatcgaaatgcagaaattctttgattactctgtaactcttccggaaaaagaagacgttatcgctaaattcaaagaaaacactgtaaaaggttctcagttcaaacagccattacttgagttctcaggtgcttgtgctggttgtggtgaaacaccttacgcaaaactgatcacacagttattcggtgacagaatgtacatcgcaaacgcaacaggatgctcctctatctggggtaactcttcaccgtctacaccatacactgtaaacgcaaaaggacagggtcctgcatgggataactctctgttcgaagataacgcagagtttggttacggtatgttactggctcagaaagcaatccgtgaaggattaaaagcaaaagttgaagctgtagcagcaaacgaaaaagcttctgaagaagtaaaagcagcttgccaggaatggttagatacttatactgtaggagctacaaacggtgcagcaacagataaactggttgcagcattagaaggcattgactgtgatgtatgcaaagacatcgttaaaaataaagacttccttgctaagaaatcccagtggatcttcggtggtgacggatgggcttacgatatcggattcggtggtgttgaccacgtattagcaagtggaaaagacatcaacattatggtattcgatacagaagtttactctaatacaggtggacagtcttctaaatctactccgacaggtgcaatcgcacagttcgctgccggtggtaaagaagtgaagaagaaagatatggcatctatcgcaatgagctatggttatgtatacgttgctcagatttctatgggtgctgacttcaaccagactgtaaaagcaattgcagaagcagaagcatatccgggaccatctctgattattgcttatgctccatgtatcaaccatggtatcaagaaaggtatgtctaaagctcagacagaagaagaattagctgttaaatgtggatactggcataacttccgcttcaatccggaagcagaaagcaagttcacacttgactctaaagctccaacagaagactaccaggcattccttgatggagaagttcgttacaattctctgaaacgttctaatccggaaaaagctgcaagactgtttgcattaaatgaagaacaggctaaagctagatacgaatatctgaacaaactggttactctgtacggaaaaacagaagagtaattcataagttagaatgatagctcaataaaattggcgggcgtcaccttcgggtgacgtccgtttttggttttatattttcaagatatgtggtaaaataaacacaatggagaaagaatagttccataagacgacaaagacttggaggttatgaaattacatgaagatagaaaacataccggcttatgagcagattttagaacaggaaattccggatattcatgcaaaaggctctttatggaaacataaaaaaagtggtgccagagtgatggtgcttgaaacagaagatgaaaataaggtgtttaatattgcatttcgtacaccgccggcaaacagtacaggggtagcgcatattctggaacacagtgtcctttgcggctcaaaagaatttccattaaaggacccatttgtagaactggtaaagggttctttgaatacgtttttaaatgcaatgacctatcctgataaaaccatgtatccggtggcaagctgtaatgatgctgattttaagaatttaatgcatgtctatctggatgctgtattttttccaaacatttatcagaaagaagaaattttccgtcaggaaggctggcattatgagttagaaaatgccgaagcacctttgaaattaaacggtgttgtttataacgaaatgaaaggggcattttcttctcctgaagaagtgttggaccgtgaagtgtttaactctttgtttccagatactccttatggtgtggaatccggaggtgacccgaatgtaattccggagttgagctattcggaatttttggaattccataaacgttattatcatccggtcaacagctatatttacttgtacggaaatatggatatggaagaacgtttaaactggatggacgaacattatctttctaagtatgatgagactgtgattgattcagccattccaaagcagaaagcctttgatacagtaaaagagctgacaatggaatatccggtttctgagaatgagccggaagaggaaaactcttatctttcctacaatattgtggcaggaaacagtcttgatgtagaacaaaataccgcatttgatattttggattataccctgttatctgcacctggtgcaccactcaaacaagcattattagatgccggtatgggaaaagatattatgggttcttatgaagatggaatttatcagccatttttctcaatcgttgcaaaaaatgcagacccaaagaaaaaagatgaatttgttgcgctgattcgcagtaccttagaagagattgtaaaaaaaggaattgacaaaaaagcgattttggcaggaattaactacatggaatttcgcttcagagaggcagattacgcttcctatccaaaggggttaatgtatggactggacgtgtttgacagctggctgtatgatgaccatcatccatttgattatctttgcaaattaaaggtctttgagaatttaaaagaaaaagcgcagactcgatattttgaagatttaatcaaagagtatttattagacaatactcatgcatcaatagtagtggttaatccaaagcgtggacttgcagcacagagagacaaagccttagaagaaaaattagaagcctacaaaagttctctttccaaagaagaagtagaaaaaatcgtggcggaaagtgcacatttaaaagaatatcaggatgcaccggaaactccggaagcacttgcaacgattccaatgttaaaacgttcggacatcagtaaagaaacgattaaaatttataatacaccgaaaaaatcaggagacacgcttctacttcatcataacattgataccaatggaatctgctatttagacctgctttttgatttgaaaaaagtgccgcaggaattaattccatacacatccatcttgaaatctgtactgggttatgtggatacagaaaattataaatatggagaactctttaatgaaattaatgccaacagtggtggcattttatttggaatacagggatttggcgattataaagataatcaggatatcagaaatatggcaggaattaaggcaaaaatgctgtataataaagtcccatttgtatttgaaatgataaaagaaatcctgatcacttctgtttttgatgatgaaaaacgtctgtatgagattattgcaagaatgaaatccagattgcagatgggacttgcacaggcaggtcacagcactgcagtcaagcgtgcgctgtcttatttttctgcaaatgcatattatcaggaacagattgcaggtgttgagttctataaagtcattgatgggctggaaagcaattttgaagcaaaaaaaggcgaattaatttccaatcttaagactttaatgaagctgattttcagagaagaaaatcttactgtcagttgtaccgcagatgaagaaggctgtaacttagtggaaaaagaacttccatcctttaaaaaatgtctgtttgatgaaccggctgaagatacggtatgcacacccatttatgaagtgaaaaacgaaggctttaaaacatccggacaggtacagtatgttgcgactgccggaaacttcagagaacagggatttgagtataccggatgcctgaaaattttaaaagtcatgttaagctatgaatatctctggatgaatgttcgagtaaaaggtggagcttatggctgtatgagtgattttaagacaagtggagacagctatctggtgtcttacagggacccgaatttgaaaaaaacgctggaagtatttgaacatactgcagattatatccgtaactttgatgcagatgaaagagaaatgacaaaatatgtgattggaacaatcagtgatcttgatgtaccgatgactccggcaaccaaaggttccgtctctttaaatgcatggttcagcaatgtgacggaagaagagttaaagaaagagcggatggaaattttaaatgcaaccgtagaagatatccgtgcacttgcagaacttgtagactgcgtcgtaaaacagcagagaatctgtgtcgttggaagcgaagaaaaaattgaacaggagaaagacctctttaagacagtagagcatttattgtaatatcggctgaaaacggtagagagaacgatagagagaccgaaataggctgagaaaaatagaaagaaaaaaggacagtgaaatgagagaagattataaatcaggctttgtcgcaattatcggacgtccgaatgtaggaaaatcgacattgatgaatcatctgattggtcagaagattgcaattacttcgagaaaagcgcagacaacaagaaataaaattcagacggtgtatacctgtgaacgtggacagattgtatttttagatacaccgggaattcataaagcaaaaaataaattaggcgagtacatggtaaatgtagcgagccgtacgtttaaagatgcagatgtgattttatggctggttgaacccggaacacaggttgggccaggagaccgtcacattgcagagcagttaaaaaactgcaaattgccggtgattctggtcatcaataaagtagatacagtaaagaaagaagaagtggcaggttttatcgaaacttatagaaaattaatcgattttgcagatattgttccggcttctgcactgcgcgcccagaatctggatacggtaattgactgcatttttaaatatttgccttatggaccacagttttatgatgaagatacgattacagaccagcctcagcgtcagattgtggcagaattgattcgtgaaaaggcactgcgtaccctcgatgaagaaattccacatggaattgcagttacaattgatacaatgaaggaacgcccggacggaagaattgtggatattgaagcaacgattatttgtgaacgggattctcacaaaggaattattattggaaaacagggggcaatgcttaagaaaatcggcagtgcagcacgctttgaaattgagcgcatgttagaacagaaagtaaatctgaaactctgggtaaaggtaaaaaaagactggagagacagtgattaccttattaagaattttggatacgataaaaaagaaatatgacagaagcaagagaagtaaccggtatggtgcttttggcagcaccggttggagattttgataagagactggtgctgttaaccagagaatatggaaaaataacagtttttgcaagaggagccagaaagccaaacagtgcatttctggccgttgcaaatccctttgtatttggaacgttttttatctatgagggaagaaccagctaccagttaaaatcagcaaggataaaaaattattttactgaacttgccaaaaagcagccaggggtctattacggattttattttctggaacttgcgtcctattattatcgggaatacatggatgcgacagagatgttaaatcttttgtatgtgacacttcgtgcacttacagtaggaaaaatggataatcggcttatccggtgcgtctttgaacttcgtgcggttttgcttaatggagaatgtccggatttcttttcctgtcaggagtgttgtaattcggaacagcttttctggttttatccggcaaaatcaggggtagtctgcgagtcctgtcacaaaaagacaaagggatatgccatcaagatggatgcctcggttttgtataccgtccaatatattgtaacttcaaagcttcaaaaattatatacatttacagtaaccgaagaagtgctggagaccctttgcaaaatgatgaaggagtacatgaaaggacaggtggacagggagttgaagagtcttgaagttttgcgggttatggagtggtagcaaaagaacacgctttacaacagggatttttatgggtataatacaatttacaggtttttcattttaaatgaaaatgatttaaaaaagcaaaagagataaggagagtattgtaaaatggaaaaaacgatggaaaaaatcgtagcactcgctaaatccagaggttttgtatatccgggttccgaaatttacggtggccttgctaatacatgggattatggtaatctcggggttgagttaaaaaacaacgtaaaaaaagcatggtggaaaaaattcattcaggaaagtccatataatgttggtgtggactgcgcaattttaatgaaccctcagacatgggttgcatctggacatcttggtggattctctgacccgttaatggattgtaaagagtgtcatgaacgtttccgtgcagataaaatcattgaagacttctgtcaggaaaatggaattgcattagaaggaagtgtagatgcatggactcaggaacagatgaaatccttcattgatgaacatcagattccatgcccaacttgtggaaaacataatttcacagatatccgtcagttcaacctgatgtttaaaaccttccagggtgtaacagaagatgccaaaaatacggtgtatttaagaccggaaactgcacagggtatctttgtaaactttaaaaatgtacagagaacttccagaaagaaattaccatttggtattggacagattggtaaatctttccgtaacgaaatcacaccgggtaactttacattccgtacccgtgaatttgagcagatggaactggaattcttctgtaaaccagatacagacctggaatggtttgcttactggaaacagttctgccttgactggctgtacagccttggattaaaagacgaagaagttcgttatcgtgaccacgacaaagaagaattaagcttctacagtaaagcaacgacagacgtagaattcctcttcccattcggatggggtgaactgtggggaattgctgacagaacagattatgacttaactcagcatcagaatgtatcaggacaggatttgacttactttgatgatgaggcaaatgaaaaatacatcccttatgttattgaaccttcactgggtgcagaccgtatggtgcttgcattcttatgcagtgcttatgatgaagaagtattagatgctgaaaaaaatgatgttcgtaccgtacttcatttccatccggcattagcacctgtaaaaatcggtgtacttccactttcaaagaaattaaatgaaggtgcattaaaagtatttgaaggactggcaaaacagtacaactgtgaatttgatgacagaggaaacatcggaaaacgctatcgtcgccaggatgaaatcggaactccgttctgtgttacttatgattttgagtctgagaacgatggtgcagtaaccgtacgtgaccgtgacacaatggaacaggaaagaattaaaatcgaagacttaaaagcttactttgaaaagaaatttgaattttaattaagcgtatctaaaaagaagagaaactctgcttaaagcagggtttctttttggcttaaatgcaagaaaatgttgtataaaaactacaaaaaactacaaaaattagcaaaataactgtgcaaaagccctataaatttcttgcgaaaaagaaaaagatttgctataatagacagcaacagcagaatttgaccagaggaggaaaacaagatggcaaaaaaaagaaatatcattgtaggtcagtcgggcggtcctacatctgtaatcaattcaagccttgcaggagtctataaaaatgcaattgagaggggatttgacaaagtatatggcatgctgcacggaattcagggacttttagatgaacaatacgtggatttatcaacacagattcatacagaactggatattgaactgttaaagagaactccgtcagcatttttaggatcatgccgttttaaactgccggaaatccatgaagataaagcaatttatgaaaaaattttttcgattttaaataaactcgatattgatgcttttatttatatcggaggcaacgattcgatggatacgattaaaaaattatcggattatgctattttgaccggacagagccagaaatttttaggtgttccaaaaacgattgataatgaccttgcactgacagaccatacaccaggatttggaagtgccgcaaaatacataggagcatccacaaaagaagtgattcgtgatgcaagcggactgacctacaagaaaaacatggttactattatggaaatcatgggaagaaatgcaggctggctgaccggagcaacagcgctggcaaaagcagaagactgtgacggaccggatttgatttacttgccggaagtaccttttgatattaaaaaatttttggaaaaagtaaaagagctgcttgaaaaacaaacttctgttgtaattgcagtttcggaaggaatcaagcttgcagatggtcgttatgtgtgtgagcttggaagttccggtgattatgtcgatgcatttggtcataaacagttgcagggaacagccacgtatctggcaaactttcttgcagcagagtgtggatgcaagacaagagcagtagaactttctaccttgcaaagaagtgcgtctcatatggcctccagagtggatattgatgaggcatttatggttggaggtgcagccgtaaaagcagccgatgaaggagacaccggaaagatggtagtcattgaccgtgtttcagatgacccatatatgagtgcaaccggtatttatgacgtgcaccgcattgcaaatgaggaaaaattagtgcctagaaattggatgaatcgtgatgccacttatgtgacaaaagacttcatagattatgtaaaaccgttgattcagggcgactatcagccgattatggtaaatggtctgccaagacatctggtgcttcgcttaaaaaaaggcaataaaaggggataaaatgtaatatttttttccattttacttgactaataatcgtcaaatgattaaaatagttagtgtgtgagcttaggctgacacagcgcggtgaaaagaagcaatttgattcatcgtatatctcactttttaggaggaatgttcaaatggcaaaatgggtttatatgttcacagaaggtaatgcaaccatgagaaacctgcttggtggaaaaggtgcaaaccttgctgaaatgacaaacctgggtcttccggtaccacagggcttcacaattaccacagaagcttgtacacagtactatgaagatggtagaaaaatcaatgacgaaattatggagcagattatggaatccatcacaaagatggaagaaattaccggtaaaaaattcggtgataaagaaaatccacttcttgtttccgttcgttccggtgcgagagcatctatgccaggtatgatggatactatcctgaaccttggtttaaatgaagaagtagtagaagtattagctgaaaaatccggcaatgctcgttgggcttgggactgctacagaagattcattcagatgtactctgatgtagttatggaagtaggtaaaaaatactttgaagaacttatcgataaaatgaaagctgacagaggcgtaaaacaggacgttgagctgacagcagaagatttaaaagaactggcagaacagtttaaagctgaatataaagaaaaaatcggcgctgatttcccaactgatccgaaggaacagttaatgggtgctatcaaagccgtattccgttcatgggataacccacgtgcaaatgtatatcgtcgtgacaatgatatcccatattcctggggaacagctgttaacgtacagatgatggcatttggtaacatgggtgatgactgtggtacaggtgttgcatttactcgtgacccggctacaggaaataacggactgtttggtgaattccttacaaatgctcagggtgaagacgttgttgccggtgttcgtacacctatgcacatttccgaaatggaacagaaattcccagaagcattcaaacagttcaaagaagtttgcaaaactctggaagatcactacagagacatgcaggatatggagtttactgtagaacatggtaaactgtacatgctgcagacacgtaatggtaagagaacagctcaggctgctttaaaaatcgcttgtgaccttgttgacgagggaatgagaacagaagaagaagcagtagctatgatcgacccacgtaacttagatactcttcttcacccacagtttgatgctgctgcattaaaagctgctgaaccagttgcaaaagcacttggtgcatcaccgggagctgcttgcggtaaagttgtatttacagcagatgacgctgtagcttgggctgcaagaggagaaaaagttgttcttgttcgtcttgaaacatcaccggaagatatcacaggtatgaaatctgctcagggtatcttaactgttcgtggtggtatgacatctcacgcagcagtagttgcccgtggtatgggtacttgctgtgtatccggttgtggcgatatcacaatggatgaagaaaacaagaaatttacattagctggtaaagaataccatgaaggagatttcatttctctggatggttctacaggtaacatctatgatggcgtaatcgcaactgttgatgcaacaatcgcaggcgaattcggcagaatcatgggatgggctgataaatacagaacaatgaaagttcgtacaaatgcagatactcctgcagatgctaaaaaagctcgcgaacttggcgcagaaggtattggtctttgccgtacagagcatatgttcttcgaaggcaacagaattgatgcattccgtgaaatgatttgttctgaaacagtagaagaaagagaagctgcacttgctaaaatccttccggaacagcagggtgacttcgaaaaattatatgaagcactggaaggtaacccagttacaatccgtttcttagacccgccgcttcatgaattcgttccaacagaagaagaagacatcaaaaaacttgctgatgctcagggtaaaactgttgaacagattaaagcaatcatcgattctctgcatgagttcaacccaatgatgggacatcgtggatgccgtcttgctgtaacttatccggaaatcgctaaaatgcagacaagcgctgttatccgtgcagcaatcaatgtgaaaaaagctcatccggattggaatgtaaaaccggaaatcatgattccacttgttggagatatcaaagagcttaaatatgttaagaaattcgtagtagagacagcagatgcagaaatcaaagctgcaggttctgaccttgaatatgaagttggtactatgatcgaaatcccaagagctgctcttacagctgatgatatcgctaaagaagctgatttcttctgcttcggtacaaacgacttaacacagatgacttacggcttctcacgtgatgatgccggtaaattcttagatgcttactatgacgctaaaatctttgaaaatgacccatttgcaaaactggatcagacaggcgttggtaaactcatggatatggctatcaaacttggtaaaccggttaatccaaaccttcatgttggtatctgtggagaacacggtggagacccatcttccgtagaattctgcaacaaacttggtctggattatgtttcctgctcaccattccgtgtaccgattgcaagactggcagcagctcaggcagcaatcgctgaaaaaaatgcataatttgttcatgtaataacatgataaaagcataaaaaatgaccttggaggtctgaagtaattcaggtcttcaaggttttttgttttaaaaagaaaaatcaaaaaagaaaggaatagagatattttatgacacaggaatcacaacagccacataaaagaagagtacgctataagggaaaatatccgaaaaaatttgaggaaaaatataaagaattacagcctgaaaaatatcaggacacgattgcacatgtcatcgggaagggaaatacacctgccggtatgcatatttcgattatggtaaaagaaatccttgattttttggaaattaagccgggtcaaattggctttgatgccacacttggttatggtggtcatacaaaagcaatgttagagtgtttaaaaggcaaaggacatatctatgcgacggatgtagaccatgaggaagcagagaagaccagaaagcgattagaagaagcaggatttggtgaggatatgttaacgattaaacttcagaatttctgtacaattgatgaaattgcaaaagaagtcggaggttttgactttttacttgcagaccttggagtttcttctatgcagattgataatccaaagcgtggtttttcttttaaggtagatggacctctggatttgcgtctgaatcaggagacaggaatcagtgcggcagaacgcttgaagacaattacaaaagaggagcttgccggtatgctctatgaaaattcggatgagccatactgtgaagaactggcaaaagcgattaccgacgaaatccgaaaaggaaatgcgattgatacgacaacaaaattgcgggaaatcattggaaagactttggattttcttccggaaaaagaaaagaaagagaccattaaaaagacctgtcagcgaacctttcaggcacttagaattgatgttaatcgtgaatttgaagtgttatatgaatttatggaaaaacttccggatgcattgcgcccaggcggaagagcggcaattcttacttttcattccggagaggacaagttagtaaaaaaagcgttgaagcaaggctacaaagacggcatctatttggattatgcaaaagatgtgattcggccgtctgcacaggagtgtgcacaaaacggaagggcacgttctacaaaaatgcgttgggcaattaaagcgtaaagaaacaaaaaagagagcaaaaatctttaaaaatcggctaaaaacgccgaaaagatggatggctctcttttttgcacaatatttttttgcattttgaaaaaaactatgatatgattaagcacatacaagagaaaatatcaagttcttgtcagagtctgacaaatttcctatcgtttaagaagaataaaaactgaaaatagcaatacttgaaaagagggttataaatagtatgagagaaaagtatttgtccttgtcattaggcacattgaaggagcttgcaaaagcaaggggaatgaagggtatttcgacattgaaaaaaagtgaactgattgaacgaatgttgcaagaagatgaaaaagagaaaaaaatagaaaaagagaaaaaagtagagaaagaagaaattttaaatacgcagcctgcaacaaagccagaaccacgttcagatcgtccacccatggagcaatctgaattagacagcggaatctgtgtaaaaggaattttagaagtacttccagacggatatggttttatccgaagtgataattatctgccgggtgagaatgatgtctatgtttctccatctcagattcgtagatttaatttaaagacaggagatattttaaagggaaatacccgagtaaagagtcagaatgaaaaattttcggctctgctttatgtgacatccattaatggaatgaagccaaatgagatgcgtcgttataattttgaagatatgacaccgattttcccaaatgagcgtctgcatttagaacgtccgggtggaagcgtagcaatgcgagtggtagacttagtcagcccaattggaaaagggcaaagagggatgatagtatctcctccaaaggccggaaaaacaacattgttaaaagatgtggcaaaatcaattttgaaaaacaatcctgagatgcatctgattattttattgattgatgaacgcccggaggaagtaacggacattaaagaagcaattaaaggttcaaatgtggagattatttattcgacctttgatgaactgccggaacaccataaacgtgtatctgaaatgacaattgagcgtgcaaaacgtctggtagaacataaaaaagatgttacgattttcatcgacagtatcaccagactggcaagggcgtataaccttaccgttccgccgagtggaagaactctttccggtggtcttgacccggcagccctgcacatgccgaagcgtttctttggagcagcgagaaatatgagagagggcggaagcctgactattcttgcgactgctttagtagataccggaagtaagatggatgatgtggtttacgaagaatttaagggaacaggtaacatggagctggtgttaaaccgaaaacttcaggaaaaacgaattttccctgcgattgatattgcaaaatccggaaccagaagagaagacttattattaagcaaagaagagcttgaagcagtggatattatgcgaaaagcattaaatggaatgaagtccgatgaagcgcttgagaatatcttaaatatgtttgcacatacaaaagataataaggagtttgtacagacagtaaaaaaacaacgttttctctattaaggcttgcatttccaaaattactatgatataatttaaaagctgtttggaattagaaacgcaaaattaatactccatcgaagattctgtttatcatggaaactttgcgtggatgcgcctggtctgtttggttttgtattttgtaccaggtgccggaaggtataaataataaattttttagaagaggtgaaaatcatgaaagaaggaatccatccaaattatcaggaatgtacagtagtatgcaactgcggaaatacttttacaactcgttctgtaaaaccagaacttcgtgttgaagtttgctccaaatgtcatccattctatacaggacagcagaaagctgcacaggctcgtggccgtattgataaattcaataaaaaatacggaatggacaaataagaaaacaaataagagaggctggggttttcggacttcagcctcttctttcgtttcagaggagttttatatatgaaatcatcaaatattggtggacaggcagttatggaaggcattatgatgcgccataaagacgtctattcgattgcagtccgtaaaccggataaagaaatcgaagtaaaagtagaagactacaaaagcgtcatgaaaaataaaaaaatcctctctctgccaattataagaggtgtgtttagttttattgattcccttgtaattggtacaaaatgtctgatgtattccgcttcattctttgaagaggaagaagaggaaaaagcaaaaaaagaggcattaagcggggatgagcttacaaaatatgaggcaaaacagaagaagcaggaaaatgtcttaatgacaattacgatgattttttctgtggtgatatcggttggactttttatggtgcttccgtatttgattgccagtcttttaagaaaagtgggagccggtgaatccgcagtaacagttgcagaggcatttatccgaattgtattgtttttagcttatctggttctgatttccaagatgcaggacattcaaagagtctttatgtatcatggagcagaacataaatgtattaactgcgtagagagcggaaaagcgcttaccgttgaaaatgtaatgaagagttcccgttttcataaacgatgcggaactagttttctgttctttgtcattattatcagtattattttctttatcggattttttgcgattgtgccggtcaaaacaatgtggatgcgtgttgtgattcgtgttctgcttgtgccggttgttgcgggtgtttcttatgaatttatccgccttgccggaaacagtgaaaataaagttgttgcgctgttatcaaaaccgggactttgtatgcagaaacttacgacaaaagagccaacaccggatatggcagaagttgcgattatggcagtagaagcggtatttgactggaaagtatatctgcgagagaattttgaaaatgccgaaggagaaataaaaaaagcagaagaggcagaacatacagcaggagaagcaaatgataacttatagaactctgctttcggagggaaaagaagtccttcaaaaagcaaagataatggattttgagatagatgcatggttgttaatggaatttgtatttcaaattgaccgtgcccgcttttttctggaacaaaatgaaacggtggaagaagaaaaagcagaaacataccgcagtctgttagccgagagggcaaaacatattccggttcagcagattacgcatgaagcatggtttttcggtctgcctttttatgtcaatgagaatgtgctgataccaagacaggatacggaagtgttgatagaagaagtgctgtcagctgtaaagaagtatagaatacagacaccaaaaatcctggatatgtgtacgggcagtggatgtattttgctgagtctgcttgtaaatatagaaggcgcagagggacttggagcagatttgtctgaaaaagcacttgaggttgcacaaaaaaatggcagtctgctgaatttaaaagcagagtggtgtttaagcaatttattttcccatataaatggaaagtatgatataatcgtgtcaaacccgccttatattgagagtgcagtgattgaaaccttgatggaagaagtaagggaacatgaaccgagaatggcactggatggtaaggaagatggtttgtatttttaccgtgaaattacaaagcaggccggagtttatctaaatgccggaggaattttagcatttgagattggatataatcagggagaagcagtcagccaaatgcttaaagaagaacaatatgaagaaataaaagtagtaaaagacctggcaggacttgacagggtagtaattggaagaaaaaaacaggaggattcccatgtttgataaattagatgatattttaattcgtctggaagaagtattaaatgaattaaatgaaccgacagtggcaaatgacactgtaagatttcagaaactgatgaaagaacaaagtgacttacagccgattgcagacgcttatacagagtataaaaactgtaagcagaccgtagaagacagcctgatgatgttagaggaagaaacagatgaagagatgaaagaaatgctcaaagaagaactttctgatgcaaagaaacgaatcgaagagttagagcatgaattaaaaatcttattacttccgaaagacccgaatgatgataaaaacgtaattgttgaaattcgtgcaggtgcaggtggagatgaagctgcgttgtttgcttctgaaatctatcgtatgtatgtaaaatttgcagagtctcaaaactggaaaacagaaatgctcagcttaaatgaaaacggaattggcggattcaaggaagttacctttatgattaccggacgcggtgcttattccaaattaaaatacgaaagtggtgtacatcgtgtacagcgtgtgccggagacagaaagtggcggacgtatccatacttcaaccattacggttgcaattatgccggaagcagaagaaatcgatttccatctggatatgaatgactgtaaattcgatgtattccgtgcctcaggaaatggtggacagtgtgtcaacacaacagactctgcaatacgtctgactcatatcccgacgggaattgttatttcctgtcaggatgaaaaatcacagttaaagaataaagataaagcattgaaaattcttcgttcccgtctgtatgagatggaactggaaaagagacatgatgaagaggcagaagcaagaagaagtcaggttggtacaggagatcgttcagagaaaatcagaacttataatttcccacagggacgagtaacagaccacagaattaagttgactttacaccgtttagattctattatgaatggagaccttgaagaaatcatcgacagtctgattgcagcagaccaggcagccaaactgagtaatctgcagggtgaagaataaaaaataaatagttttaagtgttattttaatcttaaaagataggagtaaatagcgatgggaaaatattttggaacagatggttttcgtggagaagcaaatgtaaatcttacagtagaacatgcttataaagtaggacgctttttaggatggtactatggacaggcgcataaagcgcagattgtaatcggaaaagatacaagaagaagcagttatatgtttgaatattcactggtagcaggtctgactgcgtctggtgcggatgtatacttactgcacgtaacgacaactccaagtgtttcctacgttgttcgtacagaaggatttgactgcggaattatgatttctgcaagccacaatccattttatgacaatggtattaaggttatcaatggaaacggacagaaactagaggcttctgtagaagcaaaaatcgaagaatacattgatggaaaaataccggaacttccatttgcaaaaagagaggacattggacgtactgtagatttttcagcaggaagaaatcgttatattggatatctgatttccattccgacccgtgcatttaaaaacaaaagagtgggtctggactgctcaaacggaagcgcttctgcaattgcaaaaagtgtatttgacgcattaggtgcgaaaacttatgtcattaataatgagccggatggaacaaacattaatatgaactgtggttctacccatattgaagtcttaaagcagtttgtaaaagacaatcagttagatgtcggatttgcttatgacggagatgcagaccgctgtatcgcagtagatgataagggcgaagaaattaatggagatttaattctttatgtctgtgggaaatatatgaaagagcagggcaaattaaacaacaatacgattgttaccacaattatgtccaatctggggctgtataaagcctgtgacagagaaggaatttcttacgaaaagacagcagttggagacaaatatgtctgtgaaaatatgatgcagaatggacattccatcggtggagaacagtccggacacatcattttttccaaacatgcgactacgggtgatggaatcttaacttctctgaagattatggaagttattatcgaaaagaaactgccgttaagtacactggcatccgaagtaaagatttatccgcaggttttgaaaaatgtgcgtgtgtatgataaaaaagaagccagagaaaatccggaagtggtaaaggtaattaaaaaagtagaagaagcactcggagaggatggaagaatccttgtaagagaaagcggaacagaaccggttgtacgtgttatggttgaggcatctacagatgaaatctgtaatcagtatgtcgatgaagtgattgcagtgatgagagcccagaatctggttcagtagaaatgaggaacagtgagtgaacagaaaatatagaagaagtttgatagttggcggatgccttctttgtctgctgactggctgtgcaggtaatcagaacagtaattatgagcagggtgcactggatttggaaaataaagaatatgaaagtgcaattgaaaactttgaactggcagtggcagaaaaagagcacaccgcagaagcgttaagaggagaaggaattgcctatcttcgattcggaaattatgaagaggccgagaaagcgttttcctctgcattaaaaaaagcagaaaaatcaaagacagaggtaaagacagatattttatcctatctttcctcggtagaatataagctggcagactatgagagtagtttaaaacatgcagaggcactgatggatttaaaagaaagcaaggaagctcatttcttaaaaggaagtgcagaactgcatcttgaccagtatgatgatgcaaaagaagatttttcaaaagtgatagaaaaatcagaagattatgatgattatctgcaggtttacaaagtttatgcagattatgacttgaaagcagatggcgcatcttatctggaacaggcacttgaaattgacggaacaggcaaagaagacgcttacaataaaggcagaatttattattatctggaagaatatgacaaggcaaaagaagaactttcgagttcttatgaagatggatataaagatgctgcaatttatcttggaaaggtttatgcagagctgggtgatattgataatgcaaaatccatgtatcaggaatgtctgaacgaaaaaggctatcaggcaaaggcttataatggattggcatactgtaatattttagaagaagattatgcttctgctcttaaaaatatccaaaaagggctggatgcaggagatgaagaagaaaaacagggactactgtttaatgaaattgtagtctatgaaaagacttctgattttgcaactgcaaaagaaaaaattgcagagtatttaaaattatatccgtccgatgaaaaagcggtaaaagaaagttattttctggaaaccagataaataggagattagatggaattatttgatttaagtgataaaaccgagcgtgtcatcttagtcggtgtacaggaaaatgacggagatgatacggaagaatcgcttcaggagctggcagaacttgcaaaaactgcaggagcagaagttgtaggaacagtcattcaaaagagggaacggattcatcctgggacttatgtcggaaaaggaaaaatcgatgaaatccgtactctgttaaatgcacttgatgcaactggaattatctgtgatgatgaactgagtccggttcagatgaatcatttacagcaggaactggaatctaagattatggaccgtaccctgttgattctggatatttttgcaagccgtgcagtcacgaaagaaggaaagattcaggtcgaacttgcccagctccgttaccgtgcggtgcgtctggtcggacttggaagttccctttcaagacttggaggcggaattggaacaagaggaccaggagagaaaaaactggaaatggaccgtcgtctgattaaagagcggatttcccagttgaaaaaagagctggaacatgtgaaaaagcatagagaactcttaagagaaggacgaaaaaaagaccgcgtgatgactgctgcaattgtaggatataccaatgcgggaaaatcgacgctcttaaataccttgacggatgcaggcgtgttatctgaagataaattgtttgcaacgttagacccgaccactcgcctgttagagttagatggtggacagaggatttatctgaccgatacggttggatttatccggaaacttccacatcatttgattgaagcatttaaaagtacactggaagaagcaaagtatgcggatgtgattttgcacgtagtagatgcatcaaatcctcaggtagaagagcagatgttcatcgtctatgaaactttgcgggaactgggtgtaaaggataagacaattgtcacgttatttaacaagcaggatcgtttggcaggtaatgagattcttcgggattttaaggcagattatgttttaaaaatctctgcgcgtaccggtttgggtctggatgaattaaaaaatacactggaaaaaattttgattggaaatcagatttatatcgaacgtgtgttagattataaagatgccggaatgttacagctggtacgaaaatacggtcagttaattgaagaaaaatatacagaaaatggaatcgaaatcaaagcaagagttccaaaagatatctatggaagacttggagaataaaagagttttatgaagattaaaataccatatatggtggaatgtaaaaaaattcaacccatatatggtattttttacggttgacttctccaggggcatttgctaaaatgaatctacagcgtttcaaaacaaggcgcaaacgaggaggaatgaaaagtatgtttcaggtagtaaagcgggatggagaaattgacaatttccgaatagacaaaataacaaaggccatcaaaaaagcatacgatgcaaccaataaacaattcagtgacgatatgctagacatgctggcacttcatgtgacatctgattttcagaaaaaaatcaaaaaaggaaaaatttctgtagaagatattcaggacagtgtggagaatgtactgattcaggcaggatatgcagatgttgcaaaggcatatattttataccgtaaacagagagaaaaaatccgtaacatgaaatccacgattctggattataaagagattgtcaacagctatgtaaaagtagaggactggagagtgaaagaaaactctaccgtgacatattctgttggtggattaattttaagcaactccggtgcagttaccgcaaattactggctctctgaaatttatgacaatgaaatttcagaagcacacagaaatgccgatatccatattcatgatttgtctatgctgaccggatactgtgccggctggtctttaaaacagctgattcaggaagggcttggcggaattgaaggaaagattacttctgcgccggcaaaacatttaagcgtgctttgtaatcagatggtgaatttccttggaattatgcagaatgaatgggctggtgcgcaggcattttcatcctttgatacttaccttgcaccgtttgtaaaagcagatggattaagctataaagaagtaaaaaaatgcattgaagcctttatttatggagtgaatacaccaagccgttggggaacgcaggcaccattttccaatattacattagactggacggttcctgatgatttggcagagcttcctgcaattgtcggcggcaaagaaatgccgtttaaatataaagactgtaaaaaagaaatggatatggttaataaagcatttattgagaccatgattgagggggatgccaatggacgaggattccagtatccaattccgacttattctattaccaaagattttgactggtctgataccgaaaataaccgtctgctatttgaaatgacttccaaatatggaacaccgtatttttcaaattatattaacagtgatatgcagccaagtgatgtaagaagtatgtgctgccgcctgcgccttgatttacgtgaattaagaaagaaaacaggcggattctttggctcaggagagagtacaggttctgtcggtgttgtaacaatcaatatgccgcgtattgcataccaggcagaagatgaaaatgattttatgctgcggctggatcgtatgatggatatctcagcacgttcattgaaaatcaagagagatgtaatttccaaactgctcgaggaaggtttgtatccatataccaaacgttatctgggaagttttgacaatcatttttccaccattggattagtaggtatgaatgaagccggattaaatgcaagatggctcaaatgtgatatgaccgatgtgcgtacacaggaatttaccaagagagttttaaatcatatgagagagcgtctggtgatgtatcaggaagaatatggtgacttatataatctcgaagcaacaccggcagagtcaactgcttatcgtctggcaaaacatgacagagaacgctggtcggatatccgtactgccggaaaagagggagatacaccatattataccaacagctctcatctgccagtggaatatacctccgatatttttgacgcactcgacgtacaggatgaacttcagaccctttatacttccggaacggtattccatgcatttcttggagaaaaacttccagactggaaagcagccgcttctctggttcgcaaaattgcagagaattataaactgccgtattatacgctgtctccaacttattcagtatgcaagacgcatggctatattgcgggagaacattttatttgtccaaaatgtggagaaaaagcggaggtttacagccgaattaccggttattatcgtccggttcagaactggaatgatggaaagagccaggaatataagaatcgtaccgtatatgatatcttacattctaatttgaaagcaaaaccggcagaacaaaagcttgaacaagaacagccggtgaaaacagaacaagaaacagttgtggaaactgcaaaagaagaaaaatacttatttacaacggcaacctgtccgaactgtaaaattgcaaaaaaaatgcttgagggagaagagtatcagatcatcgatgcagaccagaatccggaaatggtgcgaaaatttggaattatgcaggcaccgacgctggttgtgtttgatggggacaagatgcataaatatgtcaatgcatcgaatattcaaagatatgtagaccagatgtaagaaacaagacataagataagaaatgaagatatagataaaagaaaagcgcttcagcgagaaagtaaatcactcgccggagcgctttttgatagctttaaaatttgatggttttgcaatctattaaaacttagttctgtttttcattttttaattcggccattttcatagcacgaacttttaacggaagaccaaacagagtgataaatccatctgcatcgtggtggtcatacaggtcacctgttgtgaaagaagcaagggattcgttgtataagctgtatggagaagtggtaccggctttgatgatgttacccttgtacagtttgaatttaacttcacctgttacatattcctgagtggaagtaacgaatgcctgaattgcttcacgcagcggagtgaaccattttccttcgtatacaacctgtgcgaactggcttccgagtttcttctttgtttccattgtttcacggtcaagaatcagttcctctaactggtcatgagcagccattaagattgttccgccaggagtttcatatacaccacgggatttcataccaacaacacggttttctacaatatcaatgataccgataccgtgttttccgccaagtgtatttaattcagtgatgatttcagatactttcatggattttccatttaaagaaaccggaacacctttttcaaatgtcatagtaacatattctggtttatctggagctttttccggtgtaacactaagaacgagcatatcgtcatagtttggttcctgagatgggtcttccagttcaagaccttcatggctgatgtgccataagttacggtcacggctgtagctgtggtttgcatcgaatggaaggtcaattccatgtgctttacagaattctaactcatcttcacgggactgcatagtccatacatcagtcatacgccatggagcaatgattcttaaatcaggagcaagtgctttgataccgagttcaaaacgaatctggtcatttcctttaccggtagcaccgtggcagatagcagaagcgccttcttttcttgcaatttcaaccagtttctttgcgataaccggacgagccatggaagttccgagtagatatttgtgttcatatacagcacctgcttcaacacaaggcatgatataatcatcacagaattcatcaacaatatcttcaatatataatttagaagcaccggagagttttgcacgttcttccagaccgtctaattcatttccctgtccacagtttacacaacagcagattacttcataatcgaagttttcttttaaccacgggattaaagcagttgtatcaagaccgccagagtatgctaaaataactttttctttcatgataagtttcctcctaagatttataaaaataaattttaaaaatttcaattatgtttttcaacacggtttactatacaacaactattataattatgcaatagaaaattgaaaaaagtgtaaaaaaaataaaaaaacaagcaaataaaaggtcgaatcaatacctattttaaatgtaaaccaaatgaaattgcagaaaatgaaaaaaatcaaaaataggggttgaatattatgcataaaagatgtattattatgcaatcggagcgaatcttatgcataaaaaataaaaatatcgcataaaaacaggattcttggactttactcaaatgaagaactgcggtattatggtaaagataaagatataatcagggagtgtgttccttaaaaaaaatcgttaaaagagaggttgggaagatatgataaaagcaggaataataggtgcaaccggttacgccggaggagaattggtaagattacttttaaatcataaagatgttgagattaaatggtatggttcaagaagctatattgataagaaatactatgaagtatatcagaatatgtttcagttagtggatgacaaatgcatggatgataacatggatgcgttagcagaccaggtagatgttatctttactgcaactcctcagggactgtgtgcttctttaatcaatgaagaaatcctttcaaaagtaaaagttattgatttaagtgcagacttccgtttaaaagatgtaaaagtatatgaagaatggtataaaattgaacacaaagctccacagtatattgatgaagcagtttatggactttgcgaaatcaacagagaacaggtgaaaaaagcaagaattgtagcaaatccgggatgctatacaacctgcagtattttaacttgttatccgttagtaaaagaaggattgattgacccgtctactttaattattgatgcaaaatccggtacatccggtgcaggaagaggcgcaaagattgataacctgttctgcgaagtaaatgaaaatatgaaggcttatggtgttgcaacacatcgtcatacaccggaaattgaagaacagcttggttatgcggcaggaaaacagttctgcatcaactttactccacacttggttccgatgaaccgtggaatcttagcaactgcttatgcaaccctgacaaaagatgttagttatgaagaggtaaaagcagtttatgacaaatattataaagatgaatatttcgtacgtgtcttagacaaagatgtatgcccgcagacaaaatgggtagagggaagcaactttgtagatgtcaattttaagattgacaagagaacaaaccgtatcattatgatgggtgcaatcgataatcttgtaaaaggtgcagcaggacaggcagttcagaatatgaaccttttatttggatttgaagaaaatgagggcttaaaattagttccgatgttcccgtaaattacagaaatagcattgtaatagagcaatcaggggatattataattaaaaaaataaaattaaaagaagtacacgtcaggaggaacactcatgaaagtaatagaaggcggtgtaaccgcagcacagggatttttggcggcaggactttccgcaggaatcaaaaaaggaaatacaaaagatatggcaatgctttacagcaaagtaccttgtgaagccgcaggaacttttacaaccaatattgtaaaagcggcaccggtgaaatgggatcagaaaattgtatatgaatcagaaaaagcgcaggctgtcatctgcaacagtggaattgcaaatgcctgtacaggagaagagggctttggctattgtaaggaaactgcgaaggcagcatctttggcattaaacattccggaagattcagttttagtggcttctaccggtgttatcggacagcagattccgattgaaaagattaaaaaaggaatcgaaaatatggctccgttactttcagaaagtatcggtgcaggaacacttgcagcagaagcaattatgacaaccgataccgtaaagaaagaaattgcagttgaagttgaaattgacggaaagaacgtaaccgttggaggaatgtgtaaaggttccggtatgatccatccaaatatgtgtaccatgcttggatttatcacaacggatgttgtaatttcaaaagaactgcttcaggcagccttaagtgagagcgtaaaagatacttataacatggtatccgtagatggagatacttccacaaacgatacggtattattacttgcaaatggacttgcgggaaataaaaaaatcgagacaaaagaagaagattataaaaagtttgcggaagcattaaattatgtcaatacctggttggcaaaacatattgcagcggacggagaaggcgcatccgccttatttgaagtaaaagtgattggtgccaagtcaaaagagcaggcagtgacgttaagcaaatccattattacatcgaatctgacgaaggcagcaattttcggtcatgatgcaaactggggacgaatcttatgtgcaatgggctattccggtgcagtatttgaccctgaaaaagtagatttatattttgaaagcaaagccggaaaattaaaaattattgaaaacggtgtggctaccggatatagcgaagaagaggcaaccaaaattctttcagaaaaagaagtaacagcaattgcagatgtaaaaatgggaacagctacagcaactgcatggggctgtgacttaacctatgattatgtaaaaattaatgcggattaccgctcataaaagtacaaaaagaaacagatggaggaacgggagaacatggtaaatcagaaatatcttgaaaaagcagaagtacttattgaggcacttccttacatacagcgttttaacagaaaagtcattgttgtaaaatacggcggaagcgcaatggtcgatgaagaactcaaaagaaatgtcatcaaagacgttgtactgttaaagttagttggatttaaaccgattattgtacatggtggtggaaaggaaatcagccgctgggtaggaaaagtcggaaaagaagcaaaatttgtaaatggacttcgtgtgacagataaagaaactatggaaattgcagagatggtgcttgggaaagttaataaagaactggtcactttagtggaatctttaggagtaaaagcaatcggaatcagtggaaaagatggtggactcttaaaggtaaataaaaaactttctcagggacaggatataggatatgtaggagatataaaagaggtcaatccagcaatcttaaatgaattacttgaaaaagattttctcccgattgtctgcccggttggtcttggtgatgattttgcaacttataatattaatgcagatgatgcagcctgcgcaattgcacgcgcaatgaaagcagaaaaactggcatttcttacggatatcgaaggtgtttatagagacccggaagatacatccagtttaatttcagagctttttgtaaatgaagcaaaagcattaatcgaaaatggaaatgtcggtggtggaatgattccaaaattgcagaactgtattgatgcaattgagtccggtgtaaatcgtgtacatattttggacggaagaatccagcactgtctgttacttgaaatctttaccaataaaggaatcggaacagcaatcttaagagaaggcgagggaaagtactacaatgaagaaaacaagtagtgaatatatggaacaaacagaagagtatgtgcttcatacttataaccgttttccggttgtaatggaaaaaggagagggtgttcatctatatgatgtagatggaaaagaatatctggatttcgcagcaggaattgcagtatttgctcttggatataaaaatgaagactataatcaggcattaaaagatcaggtagataaagtcattcatacttctaatctgtattatcatgcaccgcttgcagaggctgcaaaaaaagtagtagaagcaactgggatgagcaaagtattctttacaaacagtgggacagaagccattgaaggagcaattaaagtagcaagaaaatatgcatggttaaaagatggttcaaatgaccatgaaattattgcaatgcagcactctttccacggaagaagtttaggcgcacttgcagtaacaggaaatgcacattaccaggaaccgtttaaaccattaattggcggaattaaatttgcacagtataatgaccttgaaagcgtaaaagcacagattacagaaaaaacgtgtgcaattatcttagaaactgtacagggtgaaggcggaatctatccggccaaggcggaatttttaaaaggaatccgtgccctttgtgatgaaaaagacattttgcttatcttagatgaaatccagtgtggcatgggccgtaccggaagcatgtttgcttatcagcagtatggtgtgatgccggatgttgtaaccgtagcaaaagcattgggatgcggtattccggttggagcatttgtcttaaatgaaaagacagcaaaacattctttagttgctggagaccatggaacaacttatggtggaaatccactggcttgtgcagcagtgagcacagtatttgatttgtttgaaaaaaataaaattgtagaacatgtcaaagaagttactccatatctggagaaaaagctggatgaactggttgaaaaatatgactgcttcactgcaagacgaggaaaaggttttatgcagggactggttgtagcgggaagaccggtttcagaaattacttctaaggcacttgaaaacggactgcttgtgatttccgcaggaagtgatgtactgcgtcttgttcctccacttgtcattactgaaaaagatattgatgagatgatagaaaaattagagaagagtctgtaagatacaaaagttagagaaataaatatagggtaaaaaatagaataaaataaagaataaaaaaatccttctgcggagattctaaaaagaaaaatgataattagaataattatacttagaacaacgtggagggattttttatgtggggaattttaacagcgctgctttccggagcattgatgagtatacagggtgtgtttaatacaaatttaactaaacagacgagtctgtggttggcaacaggctgggtacagattacggcttttcttatctgtgtgggagcatggttttttaccggaagagaaccgattggaaaattaatgaccgcagagccgaagtatattttagcaggaggcgtgattggtgcatttattacgattacagtcattcaaagtatggcggggcttggaccggcaaaagcagcaatgttaatcgtgatttcacagcttgtagtagcctatttaattgaattacttggaatttttggaatggaaaaagcttcctttgaatggagaaaggtaattggaatggcagttgcaattggtggaattattttattcaagtgggaatcttgacaggaggcagaagcagagttttttgtcgaacgtattttcttgcctttttaaaatagagcggatataatagaagcgtaaaaatagaggggtgtataagaaaaagaaagtaaaatggaaggggtcaggatatgagtgagtccggctatttggtttctcaggcatcaaaacttcttgaagtgcagtctcatgtgcttcgctactgggaagaagaactgttattaccgataggaagaaatgaactgggacaccggtactacacccgatatgatatacaggttattttgtgtattaaagaactgaagaaaaaaggtttttcattgaaagagataaaaaaagtaattccgctgttttatgagactgtaaaacaggaagaaacaaattcgaaaggagatgatttagaaagagaagtattagaaaaagaaaattcacaaagaatttcagaaataaaaaacttagaaaaagcagagagaaagttcgagacagccgtaaattctgtaagtcgttctgcatattctggaaaacgtaaaaaagcgcagaaagcagcaagagcgagggaacaaaaaaagaaaaaggaacagaacagacagacgaacaaaccagatgggcaggagagcggagtccctaaagagtttatggaaattttgaaccggattgtaaaagagcggatgaaagagcaaaattaccggaatcaggaagaagaaaaatgtaggaagctggatgaaaaaataagaatctgtcagaaagcaagaaaagaggttgcagtggcagtagaaaaagaaaaacaggaaaaacatcattttttccgaaaaaaaaagagtgatgcatgaagcaccactcttcatttttgtaatagctttttaataaattagccttctacgatagcttctgcaggacagacaccagcgcaagttccgcaatctacacattcatcagcgttgatttcgtattttccatctccttcagagatagcgcttactggacattctccttcacaagttccacagcttaaacattcatctgtaattacatatgccataataattatcctccttatattctctgaacttcatagctcagtttatatgcatattctaatatatttagattgagaatacaagtctttatttacaaacaatttgtgaaaaaaattatcatcttataaattcagataaaaatagttgaatatcgggggaaaaacgtttataatagggacgtacgaaaattaaggaggaaatgaagaatgacaatttctaaagatatgacaattggcgaattaatccgcacagatgaaaatattgttccgattcttatgagagcaggtatgcactgcatcggatgcccatccgctcagggtgaaagcttagaagaagctgctatggttcatggaatcgacgcagatgttttaactgcgcagattaatgattttttggcaaacaaataagaattaagccgaataattgtgagatttggtaaataaaatgccatcgggaaaattatcctgatggcatttttaagtctgttttataaatcagcaagttgttctaacgcatgaccggaaagaatacagtcagcatgttcaatcagatgtgcttctccggctaaagagaatggttttccacttccatattcggagagcatgttgcagactttattaaaatcagatggagagcttccggactgatggagcactaaactgtattcttctgcaaagtcatctttatataaagaattttttccggtaaagaaatgattcaatgctttggaagccagaattacatcatcaagtgtacggaacgtgaagttgcggattaaatcaagcttgatttctgtatcctcttcggaagtttctgatttagcagaggatgcagatgctgtattggtttcagaagaagcaggctgtggtttggaagatttcttttttgcggcagctttgcttcttgcatcataaactttttggaagaggtctaaaatatcatctgctccttcaatagctggaggggcggaaagcgtatcatttccggaagaagaaaacggtgtaaattttgaaaaacgggtatctaactcgtcagggtcttctacttttgtaatgattaagacgatactgtccattgaaattggaattgcctcaatcataagaggaatattgtccgcttcaaatccaaattcaatgtttgcctgctgcatcatatcacgaaacagacttttggctttctctgtgccataggcaagctcacttaaacgaatctggcggtcttctaaatccgcttttgttaaagtgcatcgaatctgattttcattaattttttctattttcataaatatcacatcctgtctcaaactattctacaatcaaaagaatatactttttcatttatattatatactatcaaaacgaagaatgtaaagcagttccttgttttttcataaatcttccgaattttaagtaaaaatgcttgtgggaaagcggggagcatggtatagtaatactacagataaaaaggctgggcaggttttatggaaaggaggataaaaaaacttcaaatcctttatttagtcgaaagccaaatagaataaaagcaaatgaattaatgctagaaacaaattcatttatagaaacaaatcaaaataatctgagacaattttctaatcatataaccatctggttaaatcggaacattcattcagaatgtctgtagaaatttccaatttgaaagaacaaaatataagagcataaacataagaatataaaaaaatcaaaaaacgtcaaagcttttttgtctgtaaggagatttgcgcctgtgccaaatatcagaatgttacatatctgctattttgtttctgctgttatcatatatcacaaatatgtattctgtgaatacacaaatacagaaaggcagaaaaagtgtatgagcaaagaaaaagaaccatccccgcttgggcgtgaactggaaacctatcaaacagaaggaattccgctgtggctgaacggaaaaccaagtacgccggaagaaatcgtgcatgcctgcatgattgaagaagaaggtacttatatgcgggattatgtgcagaatgaaagggggaaagtggaacggcttgaatttgatttgataaaattaaaaaaagaagaaacataaaaataaaatgctataggtccccgcttaggcataaaagaaaggctgctgctttcatgaataaaaattcggaaagtagcagtctttttgattttctctgaatcttaaaaaaacataaattgtcgaagaaagataatgacggaagcgaaaagtatgttataatgaaaaagaatttgaagataaggagcgcaaaatgagtggaaaaaaaagaaaagaaatggttcctgtcattgttgtgattttattgattgtactggttggatgtgtgggtgctttaaccgcagttatcaaaagaatgactccgtcggatgagaggatggacgttcgcacttattatgggctgacttcggatgacgatgtcgctctggttttgcaaaacacagtcagtgatagaaaagcgaaaatgatagacggacatatttatctggattatgatacagtatccgatgttttaggtggacgtttctactgggatgaagcaaatcaaaagatgctttattcaacaccgtcagaagtgatttcaatttcaccggacagtaatacttatactgccggaggaaaagaaaagacagaagaatatcctattatctgtgaaaaagaggataccatatatctggcattggaatttatcgaacaatacatgcagattatggtgacaaagagtgagaatccggataaagtgattatttcttataaatttggaacacaaaaaacggtaacagtaacagaggatacggtagttcgttatcgcggtggaattaagagtgaaattctaaccgatgttaagaaaaaggataaactggttctgctggagacactggatgaatggtcaagagttgcaacggaagatggatttgacggttatatcaaaaatgacagtatttcagatgcaaaggaagagaaaatcgagtatcagggcgaatttaatgaaacttatacaagcctgaccagagattataaaattaatttagcctggcatcaggtaacttccgaagatgcaaataaggcattatcagaagtactttccggaacaaagggaattaatgtgctttcccctacctggttttctgtgaccggaacagatggtgcaatttcttcgcttgcaagtgcggattatgtaaagactgcgcatgaggccggaaaggaagtctgggggctggtcgataattttaattcgagtgtcagtacacttgcaacgctttcaaataccgcttcaagaaatcatctggtagagatgcttctttcagaagcaaaacgggttggactggatggaattaatgtggattttgagtctatgacgaaagaggaagcccctcattttattcagtttatccgtgagctttctatcggatgcaggaaaaatcagcttgtgttatctgtggatgatccggtgccggaatttacaacttactataatcgtaaagagcaggggattgtagcagattatgtgattattatgggatatgatgaacatacggaaggctcagaaaaagccggttcggtggcatctcttccgtttgtggaaaaagggattacgcagactttaaaagaagttcctgcaaataaagtaattaatggaatgccattttacaccagaatgtggtatactgatactactggcagtgtgacgagtgaaattcttggaatgagtcaggctggacagtcagtagaaaatatgggaatgacctctgcttgggatgaaaaaacttcacagaactatgcagaactggaaacaggaagcggaaaataccagatgtggctggaagatgaacagtctctggaagaaaagctgaagttatttcaaaaatatgagctggcaggagtggcggaatggaaactgggactggagcgtaacagcgtatgggatttgattgagcagtaccttaagtagaaaatccgtaaaatgtaatgaaaattattttgcaaaaatagaaaggaagacagtgatatggcagaagaaatgtttaaaacaacattaatgggtggatttgataaggatgacgtacaggaaaaagtacagaagatgaaagatgaaacagctcagcagcagcttgccttcaaaaaagagattgaagaaaaagaacaaagaattgctgaactgcagaaaagactggaattaaaagaagccaatcaggaacgtctggaaagagagattcaggaaaaataccagaaatatgtagataattatgaaaccatcggaagagttgcgttggaagcacagttaagagcggacaaaatgattgaagaaacacaggaaaaatgcgacaagatggttgccgatgcagaagcggaagcaaagcagaaaattgccgatgcagagttagaaattgatggcaaactcttagatggaaagaaaaaatacctggcattacaggaagagatgagccagattgtagatttgatcaacagtgcacagaagcatttcgcagattcctatagcgaagtacataaaatcattgatgcaatgccgacttcttttgctgaaatggaaggtgtggaaagtgaacttctgccggaaacagagaaagaaggggcagaagtagaggcagaagtagaaacagaaactgagcttgaaacagaagcggaagcagagactgaagatgcagaaacagaagaaacacaggaaatcgaaccgttagatgaagaagacgaagacttggatgcactcgatgatttagatgaaaatttagatgacttggagctgactccgcttgaagaggaggaagaggaagaagaagaaaacagcgaggcattggatgaagatgaaaagattgcgcttcagatttcaaaactcttaaatcaggaagaccagtacatgatggaaaatgaagaagaataattttttagaagttctgaatcatttcgattgagaaaataaaaatcctttaaagcatatacttaacagagtatactttaaaggattttttatttatgaaaaagcatatcgcacagactgttatggcattgcttcttctggtttctgtcttttttctttcaaaagaaggggcacagctggcaaatggaacacctaaagaaagcaagggagtaattgttgtagacagcgggcatggcggaatagacccgggagtgattggacaaaatgaattaaaagaaaaagagattaatcttgcaattgcgaaaaagctggaacgtttgttaaaggcagctggatatgacgtgattatgacaaggaaaaaagacgaaggactgtatgaagaaaacagtccaaacaaaaaagtgcaggatatgcagaaaagatgtgagataattaaagaaaatcaccctcttttaacagtcagcattcatcagaacagttatccggatgaacaggtctgtggaccgcaggtgttttattatgaaagttcagcagaggggaagaagcttgcaatatgtattcaagaagcattgaatgaaaaattaaagattgatcatccaagggtagagaagtccaatcgtacttattatcttttaaaaagaagcgaggggatcttaaatattgtggaatgtggtttcttaagtaataaaaaagaagcggggctgttagtgcaggatgagtatcaagaaagagtggcgaaggcagttgaaaaaggaattttaaaatatctggaagattaaccgcttttatgatatgataaagatgtatgtgaagatagaaagagagtgtaattgtgattacaaaaatagtaaaagtagataaagaacatccggatgaagcggcaataaaagaagctggagaaatcttgaaaaacggtgggcttgtggcatttccgacagagacagtatatggtttgggtggagatggattaaatgctcgttcttcagaaaaaatatatcaggcaaaaggccgtccatcggataatccgctgattattcatattgcccaattggaagacttggataagattgcagaggatgttccggacggcgcaaaaaaactggcagaaaaatattggcccggacctcttacgatgatttttaagaaaaaagacattgttccgattgagacaacaggaggtcttgaaagtgtggcagtgcgtatgccgtctcataaggtggcaagagcgctaatatgctatggcggaaaatatgtggcagctccgagtgcaaatacttcaggacgtccaagtccaacacttgcagagcatgtaatagaggacttgaatggcaaagtagatatgattttagatggcggtgaagttggaattggtctggaatcaacgattgtagattttacagagaaaattccggttattttaagaccaggctatatcaatcagaagatgattgcagaggtaatcggagaagtgcgaatggataaagggcttttgattaccgatgcctctgtgagaccgaaagcaccgggaatgaagtatcgtcattatgccccgagagcggagttgaccattattgaaggagaaacagaagcagttgtagcggcaattaatgagaaatgccgtaaagcagaagccgaaggtcttcgcgttggtgttatcggaacagatgagacaaaaatgctttatcatgcatctgttgtaaaaagcatcggaagcagacaggatgaagaaagcatcggtctgcatttatttagaatattaagagagtttgacagtgaaaatgtcaatttgattttttcggaatcgtttgatacaccgaatatgggtcaggcaatcatgaaccgtctgttaaaggcagcgggacatcatgtaataaaagtataaaaaacaggaggaaaacttatgatagcattagggtgcgaccatgggggatttgaattaaaacaggagattattgcttacttaaaagcacgtaaaatcgagtataaagattttggatgttacgataataaatctgtggattatccggtttatgcaaaattagtaggaaaagcaattcagtctggagagtgtgaaaaaggaatcttaatctgtggaacgggaattggtatttcgattgcagcaaacaagatgaaaggaatccgtgcggcagtttgtacagactgcttctgtgctgaggcaacaagacttcataatgattctaacgtacttgcacttggaggcagagtcgtaggacctggtcttgcaatcaaaatcgtagatacttttttaaatacagaattttcaggcgaagaaagacatcagagaagaatcaaccagattgaagattaaaaattaaaaaaattgaattcaggaaaattaagacagcaggcttaaaaattttgcaaagaaaacaggagataagaaaatggcgaaaattaaaattatggaacatccgttaattcagcacaaaattggtatcatcagaagaaaagagacaagttcaaaagagtttcgtgaactggttagtgaaattgcaatgtttatggcttatgaggcaaccagagacttaaaattaacggacattgaaattgaaacacctcttcagaaaacagtagtaaaagagctggcaggaaaaaaacttgcggttgttccgattttaagagccggtcttggaatggtagaaggtatgcttgctatggttccggctgcaaaagtaggacacattggtctgtaccgtgacccggagactttaaaaccggtggaatattactgtaaacttccggcagactgtgaagaaagagaagtatttgtaacagacccgatgcttgcaaccggtggttctgcgattgctgcgattacgatgttaaaagaaaaaggagtaaataacatccgtttcctttgtctgcttgctgcaccggaaggattaaaagcactaagcgaagcacatccggatgttgatatctatgtaggtgcattagatgaatgtctcaatgaacatggttatattgtaccgggacttggcgacgcaggagaccgcattttcggtacgaaataaaaaaacacactttcgaagtttcagacacgaaaatagttacagtgaagattctgagaataaataaaggcagaggaaagtaatgacggggaagagaaaagattatatatcctgggatgagtattttatgggagttgcaaagctttccggaatgcgctccaaagacccgaattctcaggtgggagcatgtattgtaagttcagacaataaaatattatctatgggatataatggatttccaagtggatgttctgatgatgaatttccatgggaaagagaaggcgagccttacaataccaaatatctgtatgtaacgcacagtgaactcaatgcgattttaaattacagaggcggttctttggagggcgcaaaattgtatgtttccctgtttccctgtaatgaatgtgcaaaggcaatcattcaggcgggaatcaagacaattgtttatgacagcgataaatacagtgatacaccggcagtaaaagcatcgaaacgaatgttagatgcagccggagtccgttattatcaatatacacatacaggcagaaaaatcagctttgatgtttaaaagaaaatcagcaaaaattttcaaccttctatagttggtgagaaaaactgtattttctatgaaagagagagttttgagataacggctaaaaggagaaacagaaaaaatgaaaataaatgttccgaaagaagttcaagaaatcatttccgtcttgcaggaacatgggcatgatgcttatgcggtagggggctgtgtcagggacagtctccttggcagagcaccggcagactgggatattacaacatcagcaaaaccgatggaagtaaagcgcctttttcgtcgtaccgttgatactggaatccagcatggaacggtaactgttatgtttggcaaagaaggatttgaagtaacaacttaccgtattgatggagagtatgaggatggacgtcatccaaaagaagtaacttttaccggagaggtaagagaagacttacgtcgaagagactttaccattaatgcgatggcgtacaatgacaaagaaggactgcttgatttatttggagggattgatgatctgaataagaaagttattcggtgtgtgggaaatccggaagaacgttttacagaggatgcccttcggattatgcgtgccgtgcgttttgccggtcagcttggtttttcaattgaagaaaaaacaaaacaggcagcatcgaaactttcaggtaatcttgagaaaatcagtgcagaacgaatcgagacagaaatccgaaaacttttgttatcaaatcatccggaacttttaagaacagcttatgaacttggaatcacagaagtagtacttccggaatttgatgccataatgcagaccgaacaaaatacaccacatcattttaccaatgtgggagaacacacattaaaggctttggaattcattccggcaaataaggttttgcgttataccatgctgcttcatgatatggggaaaccgaaaatgaaaactaccgatgaaaatggaagagatcattttaaaggacatggggaagaaagcgagagaatcgcaaatgaagtgctgcatcggctaaaaatggataatgacacgataaagaaagtgaccaaactggtaaaatggcatgatgtgagaacccagccgacaccaaaagcagtaagaaaagccatgaataaactgggagaagaattgtatcctctgcttctacaggtacagtatgccgatacaatggcgcagagtacctatcaaagagaggaaaaactggaacggattcataaagtaaaagtaatttatgaacaaattattgaagagaaacagtgtttctctattcgtaatcttgcagtgaatggaaaagatttgattgcaattggagtaacgcagggaaaacagataggagaaatcttaaatatacttttagaagatgttttagaagaaccgtctcataatacaaaagaatatttacttgaactggcgaaaaataaaatcggacaggaagcatgatgcccatgttttctgtctgttttttggtttccgtttctttcgtattctttcttatactagtcctcaaaaaaactgcatacaataaaaagacagattaatgtatgagtgagttcttttggtttttagaaagagtcctatcgtatgtatggaaaataagggggaggaaaaaaggagtgcatgacagggggattagcattttagaaaagtatgatttagaagcatcggctgcaagcagaggtcgtggtgctttaatttgccagaccgggcaggggcttgttttaatcagagagtattacggttcaataagaaaattagaatatcaggcgaaactacttgaaaaaatttcaggtcaaaaagaaattcatgtagatacactaaaacgaaataaagaagaaaactatattacagttgataaagaaaatattccatatctggtaaagaactggtacgatggaaaagaatgtgatacacagtcccgcaaggatatcatgcgcagtgtaaaagcacttgccagcttacataaaacaatgcagatgccggtctgggagcattatgtgagggaatctcttttgagtgaatatgaacgccacaatcgggaattgagaaaaattaaaaagtttatatttcaaaaacatcagaaaaatgaatttgaacgctgttatctggaacatgcagaccgttatctttgctgtgcagaagaggcttttaagcgtatcagtcaatcttcttatgacagactgcgtaccgtaagcctggaaagaggctgtgtctgccatggagcgtttcatcagcataacattttgatgtgggattcagaaactgcggttgtcaactttgataattggaattatgatgtgcagatggcagatttgtatcagtttatgagaaagatattagagaaacacggttgggacaaagaactgggaaaagagatgattcaaagctattgcgagattcgcccgctcataaaagaagagagggaaaatcttgccgtccgatttgcttatccggaaaaattctggaaacttgcaaattattattatacgcacaataaagtctggattccgaaaaaaaatctggaaaaacttaaaaagctgatttctcagtacgaaaagtggcttgaatttgtagaaagtatcaacacattggaaaaataagagaaaaagatgtccggggctttttgaatacgcttgacaaactataggaaacaaggtataaataacagtatgttgaggttgtattttgcagccacagttagaatcaacattgtaaataagattatttattttaggaggaaatattcatgaacagaacagaattagttgcagctatggcagcagaaactcagttatcaaaaaaagatgcagaagcagctttaaaagcatttatcgatgtagtatctgctgaattaaagaaaggtgaaaaagttcagttagttggttttggtactttcgaagtagctgaaagagcagcaagagaaggaagaaatcctcagactggtgaaactatgacaatcgcagcttctaaaaatccaaaatttaaagctggtaaagcattaaaagatatggtaaacgcataaaaaatgagattagacaaatatttaaaagtctcccgtctgattaagcgcagaactgttgcaaatgaagcctgtgatgcgggacgtgttctgattaatgacaaaccggcaaaggcatctgcgcaggtaaaagcaggagatattctggaaatccagttcggaagcaagaatgttcgagtggaagtgctggatgtgcaggaaacggtgaaaaaagaagcagcaagcgagctgttccgttacctttaaaatttgtgtatattagagaaaaatcccccatataatctttttaagagagttgggggattttttattttggaagaaaaagtggtggaaagaagagcacataaactggaacttcgtgcaagaaataaggggagtataaccggagtcagtgatgtgctctgttttgatgaagaagagattcgtttggtgacagaattgggtattttaagtgtaaagggaaaagaactgcatgtgacacggcttgatttggaaaaacaagaggtagacattgcagggaaagtagacagccttatttacgaccgggcaaggggagaaagtgtgcagggaaaagaaggaatgataaagaggttttttaaataaagatgagcaaatatatggaacaggaatttttgcttcttctgaaacttttcctgacggggattttccttggtctgctttatgactgccttagaatctggcgcagtgtgatgacgaacagccgtttctggattgatttacaagatttaatttattggagtagtgcggggctttttgttttttatgttatatatatggaaaataacggtcagatacgtgtttatgcgctggctggaatggcagcaggagctcttttctattatgcgacaataagcagatggattgtgagactgtttggatttttattgttgaaaatcgtaactttatttggaatcttgctgactcctctacacaggggaagaaaaaggttgaaattatgtattaaaagagttaaactttttttgtatgaacaaaagtcgatacaaaaagtcaggaagaatcagaatgagaaagaaagaaaatcaaaaattcagtcggaaacgaagagaaaaattaaagaaagatgaaaatagacagccggaaagcaaaacggcgatgattagtgtgattttagttgcttctgcactttcgatttctttaatggcaagaagttatgcattagaagaaaaaataggtgactataaaagccagagaaaagaagtcaaggcacagatatcagcagaggagcagcgcacaaaagagattgaagcattaaaagaatatatgcagagtgatgaatatgcaaaacaggtagcaagagaaaaacttggactggtggaaggagatgaaattatttttaaagaaaagtgataattttgtctaaaattttttgaaaaccagaacatgtttttgacaaagtttaaaagaaaaaacatctataatactctttggacaggagtggctgtttagggagggatataagatgcaggaatggatgattgccatgttcatagtcagtatcctgttaatactgagggacatggcaaaaactgttttttcagatatgagaaaaagtgcggcaactgtaatttatgaagagcatccgcaaaaagagagaatgagacgttatgccgctgcatttcaaaagcttgcggatagtttttatggacttccttatcgaaaagactatatcagcaatggagagctggaagacatgattcgacagcttcgggatggtccttgcagaagttgtacggcgggaaaactctgttgggaagaacatcctttgcagacgtatcagattttatatcatctgcttcgtttgatggaaaaacaggatgtacagaaaatcatgtcggcaagagcgaatttaacagagttttgtatcaatcaggggaaaatgacggaacagatgcagaggctgatggaacgacagaagcaaatcctgatttggaataataaactgctggaaaatcggatggcggttgcagaacagttgggagagatggcacagcttatgaatacgctgtcgaatgaactctttgatattatccctgtagatgccgtgtttcaggaagagttaaaacgtcgtttaaagaaaaaacatattttggcaggaaatatctggatgttagaacagccagacgagaaaatccagtatttctgtgaattatatacgaaaggaaaacgctgtatttcggcagcagaagcaggacaggtactttcaaaaatgtgtggctgtcagatgacaccccgaatagagggcaagatgtttctgacaaaagaaaagatgaccgtgcgatttgtagaggatgtaaattttcggattttatatggagctgcaaaggtaacaaaagacagagaaacaatttccggtgataattatatgtgcacggcagaagataatggtcagttttttatgtgtctttcggatggaatgggttctggactcgaggcttgtaaagaaagcgaacatgtggtagatttattggaacagctggtggagtctggattttcaggggaaagtgcggcaaaattagtgaattctgttttaaatcttcagatgcggggcggtaaattttcaaccgttgatgtgtcaatcattgatttatatacgggaatgtgccatttcttaaaggctggtgcagcaacgacatttatcaagcgtgaccagtgggttgagagtatttcatcggagagtatggcactggggctggtatttccggcagattacgagtcactgacaaaaaagttgtataatggtgattttttaattatggtgacagatggagttttagatgcacttccggaggagcgggccgaggagactttaaaggaaattattttacagactcatgcgaaagcacctcaggaattaggaagaggaattttacagaaagtgctggcactttgtgaatataaggcagcagatgatatgactgtgctggcagcaggcgtatggaaaaaataaagattggaaaacagatgaaatgaaaaaggtatttttctatatcgaacaatatcagatgataaaaccggatgacagggtgattgtggggctttcaggaggcgtagactcagtagggcttctgcttttattaaaagaatatcagacagaatgtcaaaagaaatctccggaaaaaaattcttttttgcttgaggcagtccatgtcaatcatcagattcgaggtgaagaagcaaacagggacgaaacatttgcaaaagacttgtgtgagtcacttggtgtttcctgttcctgttattcctatccggttttagaactggcaaaaaagcaacatttaacggaagaagaagcagggcggatggtcagacatcgggcgtttgagacgcaggcgaaaaaggcgaaagagaccgttaaaatcgcacttgcacatcacagagatgatttggcggagacaatgattcataatctggtacggggaacaggaatcggtggaatggcgggaatccgtccggttacagagattaatgggatttcttatattcgtccgctcctttgtgtggaaaaagaagaaattaaagaatggctggaaaataaaaatcagctttgggtagaagacagtaccaacaaggaagcttcttatacaagaaataaaatccgtcagaatattcttccacagttgaaaggactgaatgaaaaagcagtcctgcatctggcaaatgcagcagaaacttttcttatggcagaggaatatattggcagaaatgcggatatgatgtataacagatatgtaatctgtaaaaaggacagaacaatcataaaacagggattatttcaggaagatagattaatgcagtcttatgtgattcaaagagcggtttctgagacagcaggtaaaaagaaggatatcggaatgttacatgtcaagctgatacaggagcttgaaaagaagcaaagcggaagccgaatttctctaatttatgggattacagtctggcagaattatggggatatctgtctgataaagggagaacttgaaaaaaaatcagaaatcgagctgaaaatggaagtatttccttatgaaaacatgcaaattcaggaaaaaaagtatacgaaatggtttgattatgataaaataaaagagattccgtgtgtgagaaaaagacaggcgggagatttccttaccgtaacgaaagagggaggaagaaaaaaattaaaagattatttgattgactgtaaagttccaagacaagaaagagacagtcttactgttttagcagacggttctcatattttatgggtagtaggatatcgtatcagcgaatactataaagttacggaaaagacgaaaacagtaatcagagtacatgtaaaaggagaaagcgaagatgagtgaaacaatcagagagttaatcagtgaagaagatgtggctgcaaaagtaaaagaaatcggagcacagattacaaaagattatgaaggtaaagcggttcatttaatctgcgttttaaaaggcggagtgttctttacctgtgaactggcaaaaagaattgaagtgccggtaagccttgactttatgtctgtatcgagttatggggatgatactaaatcaagtggagtggtaaagattattaaagacttagatgagagtattgaaggaaaagatgttcttattgtagaagatattattgattccggaagaacattaagctatttaatcgaagtattaaaacagagaaatccggcaagcatccgtctgtgtaccctgcttgacaagccggaaagacgagtaaaagatgtaaaagtagattatgtatgtttcaatattccggatgaatttgtagtgggatatggtctggactatgcacagaaatacagaaatcttccatttattggagtggtagaattctaagggcagtccggtgaaaggagatacacgaagtgaataagcaggcaagaagctggattccaagtattctgctgttgattgtattgtttgttggcggttactggtttatgaccagacagtttacaattaataacagttattcccagcaggatttctatgaatccgtacagaataatgaagtggaaagtgtatacatccatccgaacaaagaatacccaaccggaagagtgtcagttgatttaacaaatggaaattccgtacagttttacgctttggatgtaaaagaaatacaggattttttgggagattattcagaaattgcactggaagtcggagatgttccgggagataatattttcctgtcttctgtactgccgattattttagtggcagggatggcattttttctgattagtatgatgagcagacagatgtctggaggcggaggtggcggaaccaatgccaagatgatgaacttcggaaagagccgtgccaggatgacggtgaatgaagaaaataaggtgacatttaaagatgttgccggtttggaagaagaaaaagaagaccttgaagaagtagtcgatttcttaaagaatccacaaaagtatacaaaagtcggggcgagaatcccaaaaggtgtgattttagtcggacctccgggaaccggtaaaaccctgcttgcaaaagcagttgcgggtgaagccggagtgccgttcttctcgatttccggttcggatttcgtagagatgtttgttggtgtaggtgcatcgagagtccgtgatttatttgaagaaggcaaaaaaaatgcaccatgtattatttttatcgatgagattgatgcggtagcaagaaaacgaggcactggaatgggcggtggtcatgatgaaagagaacagactttgaaccagttattggttgaaatggatggttttggagtcaatgagggaatcattgtgatggctgcgacaaaccgtgtagatattttagaccctgccattttacgtccgggacgctttgatagaaaagttggagttggaagaccggatattaaaggtagagaggaaattttaaaagttcatgtaagaaagaaacctcttggagaggatgtcgatttacatgaaattgcaagaacaaccgccggatttaccggtgcagatttggaaaatcttatgaatgaagctgcgattttaactgccaaagatggaaggtattatctgacgcagaaagatatccgtcaggcatttgtaaaagttggaatcggtgcagaaaagaaaagtaaggttatttcagaaaaagagaagaaaattacagcatatcatgaagcggggcacgcaattttattccaccttctgccaaatatgggaccggttcacacgatttctatcattccgaccggtcttggggcagctggatatacgatgccgcttccagaggcagatgaaatgtttaatagcaaaaataaaatgcttgagaacattgtagtagacttaggaggaagagttgctgaggaacttattttcaaggatgtgacgaccggtgcttctcaggatatcaaacaggcaacacagcttgcaagggcgatggtgacacagtacggaatgtcagataaagtcggattgattaactacggaagtgatgaggacgaagtatttattggtcgtgatttggcgcatacgagaaattatggcgaacagaccgcagcagtgatagatagcgaagtaaaaagaatcattgatgaagcgtattcacaggcaaaagagctgattggttcacatatagatgtcttacacaaatgtgtggaactgctgttggaaaaggaaaaaatcggacgggaagaatttgaggcattgttttcagaaaatgaggagcaaaaaagcttagagaatgatttgggcggtactttgtatgatttaacaaaaagataagcagagtcgttttatagagcatgtaaaattattcaaaaaaagttttaaaataataataagattgtgcacactttttgtgccgtacatgctattataataactgtaaaaaccccccaatacattatatagtttttgctacaccccataagaagaaataccttctccaaaagaggcagtcgagagactgcctcttttactttacactcatttagaattataaagagtaattcaaacacagaccggaataaaaagagaggatgcaaaatatgaattacgaaaacttaaaaaatatgcaaaaaattcaggagtatgtgacgaacatgcgccctgctttcaataaacgtgcggtatttagtgatgagacggaaagttaccgtatgccatttgagccaaaagccggagacacagtaaaaatcagaattcgtacgaaacgtggaaatgttgatatggtctgtctggtcagcggacaagaaaaaaagaagatgaatctggttgagacaagagatgggtttgattattacgaaacgaaacttctggttggaacagaaaccattcattatcattttgaattattttccggtaaagtgcattgctactataaccgttttggtattgtaaaagatttagatgaacattatgcatttggaattgttccgggatttgaaactccggattgggcaaaaggtgcagtcatgtaccagatctttgtggatcgtttttgcaatggagataaatcaaatgacgttgtaaccaatgaatattcttatatttcagcaccggtacaaaaagtagaagattggaatcggccgccacaggcaatggatgttcgtgatttttatggtggagatttacagggagtatgggataagttagactatcttcaggatttaggtgtagatgtgatttatttcaatccgatttttgtctctccatccaatcataaatacgatattcaggattacgattatgtagatccgcattacggaaaaatcgtaaaagatggaggagaaccgttaaactggggtgatcaggataattctcatgcatcaaaatatattcagagagtaactgattatgaaaacctggaagcaagtaatcgtttctttgcacgatttgtagaagaagtacataaaagaggaatgaagatgattctggatggtgtctttaatcactgtggttcatttaataaatggctggacagagagcgtatttatgaaaatcaggtaggttatgaaaaaggggcttatgtatcggcagacagcccataccgcagtttctttttattccataatcaaaatgactggccgtataataaagactatgatggctggtggggacatgaaactctgccaaaactgaattatgaggcatcggacagtctgtatgaatatattatgaaagtggcaagaaaatgggtttctccgccttataatgtagatggatggaggctggatgtggcagcagatttgggacacagcaacgaatataatcataaattctggcgtgatttcagaaagaatgtaaaagaagccaatccaaatgcgattattctggcggaacattatggagatgccaagagctggttagagggtgaccagtgggatactgttatgaattatgatgcatttatggaaccggtgacttggttcctgaccggaatggaaaaacacagtgatgaatacaacgaaggcatgtacggaaacagtgactgctttatcggggcaatgaaatatcatatggcaagcttttatgctccatctttgatggtatccatgaatgagctttccaaccatgaccattccagatttcttacaagaaccaatcataaagtaggtcgtgtggctaatttaggttcccatgcagcatcagaagatattaataaagcggtattgcgagaagccgttgtcatgcagatgacctggcctggcgcaccgactgtttattatggagacgaagcaggggtatgtggatttacagacccggataaccgaagaacctatccgtggggaaatgaagataaagagttaatcgaatttcataaagaaatgattgcgattcataaagaaaatgaagaatttatcaaaggttctttaaaattccttgcaaatgattatcaattgctttgttatggaagatttacgaatacacaaagaagtgtgattgcaatcaataacagtaatgaagctaaaacaatttctctgtcggtatgggaacttggaatctcacgatccagagaaattcactttaaacagttaattgcaaccggtgatttcggttatagcctgataaagaaagtatctgtctgtaaaggcggtgtgcttcagctgaccctgccatcacatggtgcagtcgttcttcgttgtaccgaataggaaaaagtgcgttaaagcacgttaaaatacgttagaaataatgaaaataaaaatatgaattgacagacaatacagggtttgatataattattttcaataaagagaaatgctaagacgaggaggagtacatgctcaaccggttttcagagagaagatggcaggtgagaatcttcagcaagggagtatggaagtagcctctgagcagtgagacgaacgaagtggataacaggctttcagtagcgctcaacggaagtttccaacgttatatggaaaatgatatcgaaaaaatctgatttttttccgtatcagcagagtgcaggaagagattcctgaaattaggtggtaacacggattgtttattcgccctaagccagagatggtttagggcgtttttttatcccctcgtgagggcactcaagtaaatttgaattaggaggaaacgatatgaaagggacagaattgtttgtaaaggcattacaaaaagagggaattgattttctttttgcttatccaggaggatatgcgattgatatttttgatgaattatataagcaggattccattcaggtaattctgccacgtcatgaacaggggctggtacatgcagcggatggatatgcaagagcaactgggagaaccggagtctgtcttgtaacaagcggacctggagcaacaaatctggtaacaggaattgcaactgccaattatgatagtgttccgcttgtttgttttaccggtcaggtaccgacaagcttgattggaaatgatgcatttcaagaagtagatattgtagggattacaagaagtatctgtaaatatgcggtaacagtaagaaaaagagaagatcttggaagaattattaaagaggcattttatattgcaaataccggaaaaaaaggaccggttgtagtagaccttccaaaagatattatgttagaagagggcgatgacctttatccaaaagaagtaaaaatcagaagctataagccaagcaaaggtgttcatatcgggcagcttaaaaaagcaaattccctgctttcacaggcaaagaaaccattatttttaatgggtggcggagtcaatatttccggtgcaaatgaagaagcaaaaaaacttgcagagctgacacaggttccggttattacaaccattatgggaaaaggggcacttccaacaaatcatgaactgtatattggaaatgttggaatgcatggatgctatgccgcaaatcacgcaatcagtgaatgtgacctgttgttttcgattggaacacgttttaatgaccgtattaccggtaagattgatgagtttgcaaaaaatgccaaaattgttcatatcgatattgatgcggcttcgatttccagaaacattcaggttgatatcccgattgtagccgatgcaaaagaagcaatgacagcacttttaaaacatgccagaccatgtgatactaaagactggcttgaagaggttcgtggatgggaaaaagaacagccacttggtatgaggaaagataagggaatcacaccgcagaagattatcgaatgtatgaatgaagaattaaaaaaagcggttgttgtaacagatgttggacagcatcagatgtgggtaacacaatatctggaaatggatgaaaacaaaaaacttttgacttccggtggtcttggaacgatgggatatggacttccggcagcaatcggtgcaaaattcggttatccggatacccctgttatctgtgtttccggtgatggtggagtacagatgaatattcaggagcttgctaccgcaacagcttacggacttccggttattctctgtatctttaataacagttatctgggaatggttcgtcagtggcaacagttattttatggaaaacgttattcctctacctgtaccagaagaagaaaatcttgtagtgctacctgcaaaggacctggagaacagtgcccaaaatatcagccggattttgtaaaattagcagagagttatgaagcttatggaatgagaattgaaaaagaagaagatatcaaaaaagcatttgaatttgcaaaagaacatacagatgcaccgaccatacttgaatttatgattgacagcgatgagctggtacttcctatggtacaaggcggacaggcacttgactgtatgattttggactgctaaggaaaggagaaaatgattatgaaaaaaagatggatttcattatatgtggaaaatgaagtaggtgtactggcaaaaattgcaggattattttcaggaaaatcctataatttaatgagcctgacagtaggaacaacggaagattcgaccatgtcacgaatgacaatcagtgtggaaagtgatgatgccacatttgaacagataaaaaaacagctcaaccgctgtgtcgaagtaatcgaagttattgattttacaaattgtccgattcacagaaaagaagtattgtatatcaaagtgaaaaaatgtgatgaaaaaataaaaaatgaagtgcttagaattgcaggtatctttaaacttccgattgtggattatggaaaagaagaaattttgctggaatgtatgcagacagaaaccaggaatgatgaaatgattgcttatttctcacagtactttaaaaatatcgaagtagtaagaggaggaagtgtagcaatccagggagttagtattcaggataaataagattaagaaaaacagaaaataagaaaacagtgtcggtttaatacggaatggttcttgaaccggcactgttttttggtgtgaaaaatcggtacaaatttggtatagaataaaaaaatactccaaatccagtaagaatttggagtaaaaaaatgccgcagaccggaatcgaaccggtacgggtatcactacccacgggattttaagtcccgggcgtctgccagttccgccactgcggcataataaaataaataggatgggcgatggtggattcgaaccaccgaaggcgttgccagcagatttacagtctgtcccctttggccactcgggaaatcgcccatatttatttttgccatttgtcctgacaaggtattattataacagataaattagaaaaatcaagaactttttcaaaaaaattagaaaaatctttattgctgtttcgtacagaaaaataatagaatatagtgcaaaaatcaagaaattgttgtataataaaaacaacaaaaaatgaaagtacagacaataatgcaacaaattgcgggaggtgtctttatggggaaagtaattacaatcgcaagagaatttggcagtgggggaagaataattgcacaaagtctggcagaacagttgaagattggattttatgataaaaatctgattacacttgctgctgagcggaaaaatctgccggaagagagattagagcgggtcgatgaaagaagagaaaacccgtggcgctatgatatggaagatgatattgccatacagagacagttttattatgaaccactcaatgatgtattatttgaagcccagagtgaaatcatcaaagaaaaagcagaaacagaagattgtgtaattgtaggaagatgtgcggattatctgttaagaatcaaaccagattgccgttgtgtttttattacggcaccgttggaaaaacgaatccgaaccatttctgcccgcaccggattagatgcaaaggcagcaaagcaattaattaaaaaagtagacaagcagagaaaatattactatgaaaattatacggaccgaaagtggggaaaacatcatggatatgacctctgtcttgacagcagtagattgacgaaagagcaaattcttaaaatattgactacattatatgaaaccattgagtaagctgtagttacaaaattaagtgcaaaaaaattatgagaacacataaatcagagaatgtataagaaatgtataagataagattagaagcgagggtcaaaagccctcgcttcttttgagaaagtttttcattttcagaaaaaatcagcataaaaaaggaccattcaaagttgacatttcgaatggtccttttaattattattatccattggattataccttcctgatttttagatttttttgggataaaacgttaagttttcggtggtccgtacctcctgttcttgaatttttaataaattttaaggtaaatcattatgtttctggtggtctgtaccttcctttcataaaaatatgaggtattacgttatgttcttggtggtatcattcctttcgggtttgtttgcttcgttctctttgtttatgatgttattatatcaggtaaaaatcaaaatgtcaataactaaattgaaaataataaaaaaaataataattaattttaaaattgatagaaaatattgtaattatcagaaaattataaacgataattttttgcctctgtatagcaactaacatctggcagaataaagaaaagagtgctatacttcatacagaaaaaacagaatgaatcataagcagaaaggaattaaaataaaatgaatcaaattggaagaaacgatgcatgctggtgtggaagtggaagaaagtataaaaaatgccatgagaattttgaccataaactcaatcttcttcatagtcaggggcttttagtaccttctcataaattaattaagacagaagctcagattgcagaaattagaaagagtgcggagattaatgtaaaaatcttagattatgttgcagaacatattaaagagggaatttccactgctgaaattgacaaatgggtatacgacatcacaacaaaagaaggagcaattccagctccgcttggatatgaaggatttccaaagagtgtgtgcacttcgattaataatcaggtatgccatggaattccatctgaagatattattctggaagaaggcgatatcatcaatgttgatgtgtctacaattttaaatggatattattccgattcttctcgtatgttctgtatcggagatgtcggggaagagaaagcacgtctggttcgtgttgcaaaagagtgtgtggaaaaaggtcttgaacaggtaaaagcgtggggctttttaggagatatgagtcaggcagtgcatgaacatgcagtaaaaaatggctacagtgtagtaagagaaattggtggacacggagttggtctggaatttcatgaagacccatgggtcggttatattggagcggcaggaaccggaatggtaatggcaccaggactgatgtttacaattgagccaatggttaatatgggaacagatgaaatttttgtagatgaaagagatggatggaccatttatacagaagatgatatgccgtctgcacagtgggagattatggttcttgtaacggaaaacggaccggaagtcattgcgtggtaagaaaagaaagcagaaagaggaaaggaaaaaagtaaaatatgagtattgcagttgcagtgttgaaaaaaggggaaggacgtgcattaaaatcaggcggaccttgggtttacgacaatgaaatcgcaagtattatgggaaactttgaaaacggagatattgtgattgtacgtgatttcgacggctatccgcttgggagaggatttattaacaccaattcaaaaatccggatccgtatgatgacaagaaatgaaaatcaggaaattgaccgtgaatttttaaaaatgagagtacgagatgcatgggaatatcgaaagaaaacggtagatatctcaagctgtcgtgtgattttcggggaagcagattttctgcctgggatggtgattgacaagttttcagatgttcttgttgtacagtctttagcacttggaattgataagttaaaaatgataatcattgaagaattaaaatcagcaatggcagaagatggtattacaatccgtggtgtttatgagagaagcgatgcaaaagtgcggcttcaggaaggaatggaaagagtcaagggatttatcggtgaaccatttgatacgaaagtacagattgtggaaaatggtgtaaaatatattgtagatatagaagatggacaaaaaacaggttttttcttagaccagaaatataaccgtcttgccattcagagattatgtaaagatgcgaaagtcttggactgctttacgcatacaggctcttttgcgttaaatgcgggaattgccggagcaaagagtgtaaccggagtcgatgcctctcagcttgcagtagaccaagcaacagaaaacgcggagttaaatggactcgaaaagcgtgtaaaattcatttgcgaggatgtctttgagttgcttcctaagttagaagccgaaggagaaaaatatgacgtagtaattctcgaccctcctgcgtttacaaaatcaaaaaattcgattaaaaacgcagtgaaaggttatcgagagattaatttgcgaggaatgaaactggtcaaagacggcggttatcttgcaacttgttcttgttctcattttatgtcgtatgagttgtttacccagacaattggacaggcagcaagaaatgtgcataaacgtctacgtcaggtagaataccgcacacaggcagcagaccatccgattttatggtctgcagatgagtcttattacctgaaattctatatttttcaggtaattgacgaaaaatagaaaataaaatattgacaatcttttttatccatgctatgttgtaattgcttatatgactgacggaagtggaatcaaccacagggagtataagccgttgaagccgaccgtctgggcattggatgttcagaaagtgggcttttttttcgttattatatagaaaattttgttctatgaaatgaaagtcaacggatcaattaaaaatgtatgatgggaaaaaggagagacattcatgaaaatgttatcgctggaaacagaattaaaagaaaatgcttatcctggacgaggaattgtaattggaaagtccaaagatggtacaaaagcagtgactgcttattttatcatgggaagaagtgaaaacagcagaaatcgtgtgtttgtagaagatggagagggaattcgtacacaggcatttgacccgtctaaattaactgacccaagcttaattatttatgcgccggttcgtgtactgggaaataaaacaattgtgacaaatggtgaccagacagataccatttatgaaggaatggacagacagctgacttttgagcagtctttaagaagccgtgaatttgagccggatggtccaaattatacccctcgtatttccggagttatgcacattgaaaatggaaaatacaactatgcaatgtcaattttaaagagcaataatggaaatccggatgcctgcaaccgttatacctttgcttatgaaaatccggtagcaggagagggacattttattcatacttatatgcatgatggaaatccacttccaagttttgagggagaaccaaaactggtagagattccagatgacattgacgcattcacaaaaaatgtatgggaaagcctcaatcaagacaataaagtttctttatttgtacgtttcattgaccttgaaacgggagactatgagactagaattgtaaataaaaatcagtaatctaaaaatgttacggcattagagtatttttaaatctgttctaacaataaaggagaaaatgagaatgaaagaattagcattaaagtatggatgtaacccaaaccagaaaccgtccagaatttatatggcagacggaagtgagcttccaatcgaagtaatcagcggaagacctggatatatcaactttctggatgcatttaacggttttcagttagtaagagaattaaaaaaagcgaccggacttccggcggctacttcttttaaacatgtatcaccagccggtgcagcagtgggacttccgttaagtgagacccttgcaaaaatttactgggtagatgatatgggagagctttctccgcttgcctgtgcttatgcaagagcaagaggtgcagacagaatgtcttcctttggtgattttattgcactctctgatgaatgtgataaagatacagcgatgctgattaaacgagaagtttctgatggtgttatcgcaccgggattttccaaagaggcacttgaaattttagcgcagaagaaaaacggaaactataatatcattaaaatcgatgaaaattatcagccggcaccgttagagcacaaacaggtttatggtgtgacatttgaacagggaagacaggaacttccaattgatgatgaactgctttccaatatcgtgacagaaaataaagtaattccggaaaatgcagtcagagacttaaagatttccctgattacattaaaatatacgcagtccaattccgtctgctttgtaaaagacggacaggcaatcggtatcggtgcaggacagcagtctcgtgtacactgcacaagactggcaggacagaaggcagataactggtggttaagacagtgcccgaaagtcatgaatcttccatttattgatggaatccgtcgtgcagacagagataatgccattgatgtttacattggagaggaatatatggatgttcttgaagatggtgcatggcagagaatcttcaaggaaaaaccggaagtctttacaagagaagagaaacgtgcatggttagataaactgaccgatgttactcttggttctgatgcattcttcccattctcagataatattgagcgtgcacataagagtggtgtaaaatatattgcagagccaggcggttctgtaagagatgatgcagtaatcgaatgttgtaataaatatgatatggcaatggcatttacaggcatccgtctgttccatcactaaaattacaaaaattatttttaaaagaggcggcagtgagaattttcttactgctgctttttgctgttctaaaaaagtgaaattttagttgaagacaaaaatagaatttgctatactgtatacgacgtaacgggattgtggttggacagaccgctgcgaaataaatttacaggagaggtttaataaaatgagtataagaattggtatcttaggttatggtaaccttggaagaggcgtagaatgtgcaatcaaacagaatgcagacatggaattaaaagcagtatttacccgtcgtaatcctgcggatgtacacattcttaccgagacagcaaaagtatattctgtagatgaagcagtaaaaatgaaagatgaaatcgatgtattgattctctgcggaggaagtgcaaccgatttaccggtacagactccagaatatgcacagtactttaacgtagttgacagctttgatacacatgcaaaaattccggaacattttgcagaggtagatgcagcagcgaaaaagagcggaaaaatcggcttaatttcagtgggctgggacccgggaatgttctctttaaatcgtttatatgcaaatgcaattcttccggaagggaatgactatacattctggggtaaaggtgtaagccagggtcattccgatgccgttcgtagaattgacggcgtaattgatgcaagacagtatactattccggtagagaaggcgttaaacgctgtaagaaatggtgaaaatccggtacttgcaacaggcgaaaaacatacaagagaagtttttgttgtagctgaagaaggtgcagataaagatagaattacaaatgaaatcaaaacaatgccgaattattttgatgaatatgaaacaacggtacatttcatcagcgcagaagaaatgaaagcaaatcatgcaggacttcctcatggtggatttgtaatccgcagcggtcagacaggatgggaaaaagaacatcatcatgtcatcgaatacagcttaaaactggattctaatccggaatttacatcttctgttattgtggcttatgcaagagcagcttaccgattaaatcaggaaggacagagcggatgcaagactgtatttgatattgcaccggcatatttaagtacaaaaacaccagaagaacttcgcaaacatatgctttaataagcagattgggagaggatatcagtgaattttgatttaaaaacggaagtaaaacgaatgggtctgggcttgatcagtgcactgattatggcagtgaatattaaaacactggtaagagcaggggggttgtatccaggtggctttaacggaattacccttttgatacagacaatctgcgaacgatttttgaatctgcagattccatttacagcagtcagcctgttgttgaatgcaattcctgttattatttgttttcgggcaattggcaagaagtttacaagtacttcagctttgattgttattgtaaccagtgtgcttacagacttagttccttatcatccaattacagatgatattctgctgatttctgtgtttggcggtattatcaatggatttgcaatcagtttgtgcctgattggaggcgcaagtgccggaggcacggactttattggaatttattttgcagaaaagaaaaataaagacgtatggaattttattttacttggaaatgcctgtgtgttgaccattgccggagttttatttggctgggataaagcactttattccattattttccagtttgcttctacgcagatgatacatatgcttcatactgcctacaagaaagaaactctctttattgttacggatcgtccggatgatgtttataaagaaatttatgaagtgacaaaccacagtgcaacagagtttgcggcaacaggctgttattctaataaacagagaaagatgttgtattctgttgtatcttcttcggaggcaaaagttttagtcagtcgcgtacagaaggcagacccggaggcatttatcaatgtgattaaaacggattttctggaaggacatttttatcaaaaagttgactattaatcggattagtttggtacaaacattgggtgtgtcacagtttgttccgtaaaaattaagtaaaaggactattacaaaaatgtgaattttttgtgatagtcctttgtttttttaccattttgtggtacagtaataagtggagtagagcgattaaaaatcgtgaaaaataaacgaaaagagaagtcgaaagttgtttcgacgagaattaaggcagcttattgtaagacagagggaaaatacagagagtattacaagcagcaggaggaactaaatgaaaataaaagaagtaaaaaaactgctggcaatcgctgtgagtgtttctatgcttacaccgtcaggtgtatttgcatcagaagcttccagtacagaggcagcagtaacggctgaacagacaacaggggaaacgagtgtgacagagccggagcagtcatcaggagaggtttctgaaccggaacagccatctgaaccagaacagccgtctgaaccggaacagccatctgagccggaccagccgtcgaatccagacaaaccagaaaatccggatcagccgtcaaacccagataaaccagaaaatccggaccagccgtcaaacccggataaaccagaaaatccggatcagccgtcgaacccggataaaccagaaaatccagaccagccgtcaaatccggacactccggaaaatccagataaaccagcccagggtatgactccggagcaatatgaggcatcaaccggatataaacttccggatggttatgcttacgtgctggatgcaaatggatatgtcattatcgaaaatggtgcaccaaagcttgcgaaaaaagcagaagataatacaaaaaaagacgataacaataatcagaataataacaataacaatagtaatagcaataacaatagcaataacaatagtaatagtaataacaatagcaatagcaattcttctaatgataacagcagtgataccaagaaagatacggagaaaaaagaagatacaaccgcagcaaacagtggaagtggttcaaattcccagttaattgcaaatcagcagatttattcttctctgcctacaatggtggatgatttccgtttctggacagttgcaaagaaatatgcctttgcaaaagaagaactgtcaatcgtagaagaaatgaaggatggagcaaaagaagtaggtaaactgtcaaaagatggtgtctgctatattcttcaggaagaaaacgatggatggctttttgtagagtcaggtgatgtacgtggttttgtaaaaacagagcaggtgattttaggcgatgaagcagaccagattgtacagaaactgacggaagaggcaaaaaaagaagcaaaagaacagaaaaagacatacaaaggaattgcaaaactgttgacagaagcaacaccgagcgttccggaatccgaaaatggagcatttttccatactcgttctacggtaaaacagaccgttgtggataaagtgtatgcactttgtaatgcagattttgtagcaattcatgaagataaaaatacggagagtcgtgctgtcggaacgttaaacaaagacaatatctgttatattttagcagacgaaaatgcggagtttgtttatgtggaatccggagatgtcagaggatttgtagaaaataaattccttgatacggacaagaaagaaaagaaaaaagcagaaaaaagtttgttaacacaggcaacagccgcagcttctgctcttaagaatacaaaagaggtcatcagtctgttccctacaacaaaaacggctgctgaccagaatgatgatattgataacattatcagtaataaaatttctgcaaccggagaagaccagtttgtgaccgcacaggaagtcgtaaaaccggcagaaaatgcagcctgctattatactttgacttctgtaaaatctggtgttccaaacggggaactgagaacttcgattgttcagtttgcaagtcagtttattggaaatccttacgtatggggtggaacaagcttaacaaacggtgcagactgttctggatttgtacagagcatttatgctcagtatggttatacactgccgcgagttgcagaagatcaggctcagtatggtacaaagattccagtagaagaagcgcagccgggtgacttgattttctatgcaagaaatagttatatctaccatgttgttatgtacgcaggaaatggagaaaccgttgaagcacagagttcaagaactggtattgttcatggaacggtcaatacgaacaatgcagtatgggctgttcgtattctcgaagacactccgtctacagtaagtggaatttatggaagtgatatttctgaagtaaatgcaacacttctgcagtatggtcagtctcttggtacatttaaaattacacattattgtggtggttcctgctgtaatgatgaatgggcaggtgtaactgcgacaggcgctccgttagtagagggagataccattgcagttgacccgactgtcattccttatggaacaaaagtcattatcaatggtcatatctttacagcaacagactgtggtggagcaatcaaaggaaatcgtatcgatgtatttgtaaatgaccataatcgtgcaaatcagcttggcgtttactatactgatgtgtatgttttaaaataaaaattacataaaaatgataaaattcgccacctgcataggtggcgaattgatttgtaaaaagaggaaggagcgtatcgtatgatttatacaagtcatttattagaagatacgcagatgcaggaagtggttcgtgaatgtgcgactggtatagagagtattgaattttcaattgctgaaaatctggatcgtttggaagaaaaaatcagcagttatcgagaacgactctggagaatgggatggccgcatttgtcccttcacggtccgtttctggatttgaatccgatgacgtatgattctttgattttagaggcgacaaaaaaacgctatgagcaagtctacgaagcaggaagacgtctggaagcagaaaaaattgtttttcatacctgccatttaccggatgcctatctgttgattggctgggcagagcgtgtggcagatttttttaaacggtttttagatgggaaagatggaatcatgattgtaatggaaaacgtatttgaccggattccggaaccgatggtggaagttgtagaacgggtagaccgtccggatttcagactctgtctggatattggacatgcacattgttattcggatatttctgtcctggactgggcaaaaagctttggcagttacgtcagtcatgtccatgttcatgacaatatgggtgacagagacagtcatattgcacttggagaaggaacaattccttatgaagaagtgctgggattattaaaacagaataatccacagatggattgtacgattgagtgtagtagtcttgaaaaggtaaagaaatcttatgcctgtctgaaacagttaaaagaaaatggtatcttatgaaaaataaaaaagggcacattctggcgaaaaccaggatgtgccctttgtaaatatgactgcggcttggctgatttgtactgtcaggcttatccttgatggttaaaacagtaggtgcacattttgcatggacttaagccgatagaggcagttaggtcatctaaacgatgatagtgcagagttgtgaagtttaactgttttccgatttcctctaacatttctttatagtttgtagagtctggatcggcataatcagcaagtactttatctgaaacgttgtctccttcacgctttgcgatgatacggcgggtaattagatccatctcagatttggaacgtgagaagtttaagtacggacaaccgaataaaagcggaggacaagccggacggatatgtacttcttttgcaccgctgttatataaaaattctgtagtctcacgaagctgtgttccgcggacaatggagtcgtcaattaagagcagactcttatttttgattaaggcttcgacaggaattaatttcatacgtgcaatcagatttctttggctctgatgtgtcggcatgaaagaacgaggccaggttggtgtatacttaataaatggacgagaaaatggaattccagactcatttgcataaccgattgcatgtgcagtaccggaatccggtacaccggcaactaaatcaggtttcacatggtctcttccggcatcatgctgagccagttttttaccacattcatatcgcatttcttcgacattgattccttcataagtagaagttggataaccgtagtaaacccagagaaaagaacagattttcatttcatttccaggttttacaagagtttcacagccctcagcagtcagaaaagcaatttctccaggaccgagttcgcgttcggtttcgtatccgagatttaagtaagcaaaactttcaaatgatgcacaataagcatctgattttttaccgataacaatcggagtacgaccaagtttgtctcgggctgcaaaaattccttttggagttaatacgaaaagagtcatagaaccatctatcatttcctgggcatactgaattccctctacgatagacgatttctggttgataagagaagcaaccatttcagtcgggttgatacttccgccgctcatctcaagaaaatgtgtgcatccgtttttgaaagaaagattgacaagttcctccatattgttgatttttcctaccgttgtgatagcgaaacttcccagatgtgactgtaccagaagaggttgtggttctgtgtcggaaatacatccgattccaagccggccttcaagttcatctaaatctccatcaaatttggtacgaaacggtgtgttctcgatgttgtgaattgaacgcgcaaagccgttttcaccatacactgccataccacctctgcgtgttccaagatgagagtgatagtcagttccgaaaaataaatccagtgtacaactggatttagaagctactccaaagattccacccattgtttttctcctttttcttcagaattctttttttatagtacgtggaatattatatactcttttttaaggattcgtaaagatatttttgaaaaaatggtgtataatgaagcgaagagttaaaaaatagcgtgaaaggggactgtttatgaaatttatttcctggaatgtaaacggcttaagagcctgtgtacaaaaggggtttatcgaatattttaatgaaatggatgctgattttttctgtgttcaggaaacgaaattacaggaaggtcagatcgactttgcaccggaaggatatcatgcatactggaattatgcggtaaagaaaggctattcaggaactgccatttttgcaaagaaagagccgattgcggtgacttatggtcttggtattgagcagcacgatcaagagggcagggtgattacccttgagtatgaagatttttatgtcattacctgttatacgccaaattcacagaccgaattggcaagattagagtatcgcatgaaatgggaagatgatttccgtgagtatttaattggactggataaaaagaaacaggttattttctgtggggacttaaatgtggcgcaccgtgagattgacttgaaaaatccaaagacaaataagcataatccaggatttaccgaagaagagagaggaaaattcaccaaactgttagaggcaggatttacggatactttccgatatttttatccggaagaaacgggaatctattcttggtggtcttatcgttttaaggcacgtgataaaaacatcggatggagaattgactatttttgtgtctcaaaccgtttagaagaaaaactgatttctgcaaaaattcatacagaggtactgggttctgaccattgcccggtagaagttcagattaatttataagaaaatgcactctcggagtctttcatgcacttgcacaaaaagattccgagagtacatgaaaatcaaaaagaggtacagagtttaatgaaagaaagtgtaaaattgacgcagtttgcaaaaagtgctggctgtgcggcaaaaattggaccgaaagtgttggctgagattgttggaggacttccgaaatttttcgatgaacatcttttagtcggaacagagacaaatgatgacggcgcagtgtatcagatttcagatgaactggcactgattcagacacttgattttttccctcctgtggtagatgagccttctctttttggagagattgcggctgcaaatgcattgagtgatatttatgcgatgggcggaataccaaaaattgcattaaatattgtggcgtttccaaactgcctgggtcaggaagtgttaggtgaaattcttcaaggtggtgcgaagaaagtgcaggaagcaggggcagtgcttgccggcggacattccattaacgatgaagagccaaaatacggtttgagtgttacaggctttgtcaacccaaagaaaatgtggaaaaattcaggtgcagagccaggggatgctttgattcttaccaaaccaatcggaacagggctggtcaatacggctgcaaaagctgatatggtatcagaaacatcaagaaaacttgcaattggacaaatgagatgtttaaattattatgcatcagaaattttaaaagattatgaagtacatggatgtacagatgtgacaggtttttctcttgccggacatgcacttgagatggcggaagggagtcaggtaaccattaaaattgataccaaaaaaattccatttttaccggatgtggaagagtatgccaaaatgggtctggtaccagagggaacgtatcgaaataaagaattcttaagagaaaaaatcaaattaaatgatacaataaaagaaagttttgaagatttgttgtttgacccgcagacttcagggggacttttagtcagcctgaaaaagaaagatgccaaagaagttttgaaaagacttcaggaacaggaacagacacgctacagcaaaattgtcggtgaagtagaagaaaaacaggaagtacatttaatatttttgtagaacaaataactctctttggtgcaaagtaagccgaataaagactcagagagtacacgcagatagtaaggagtaagagaaatgatttatctggataacagtgccacgacacttaaaaaaccggattgcgtaaaagaggcggtctgggatgcaatggagcagatgggaaacagcggaagaggcggatatcagactgcattatcggcatcaagaatgatttatcaggcaagaatggcagtttccgaattttttgacttgaatcatccatccggtgtggcatttacctccaatgcaacagaagcactgaatactgttattcagggattattttcaaagggggatcatgtgattaccactgtgctggaacataattccgtcttgcgtccgctttatatggagcaggaaagaggtgtggaactcagcataatcggtgcagatgaacaggcagatgtgttatatgagaaactggaatctgcaatcaagtgtaatacaaaggctgtgatttgtacgcatggctcaaatgtaacaggcaatctggttgatattaagcggattggagcagtttgcagggcacatcaattattatttattgtggatgcctctcaaagcgcaggctgtattccaatttccatgaaagaaaaccagattgatattctttgttttaccggacataaaggacttatgggaccacagggcacaggaggaatctgtattcgtccacagatttccatccggccgttaaagagtggaggaacaggcgtcctgtcgtttttaaaggaacagccacaggaattgcccgagcatctggaagccggaacattaaacggacatggaattgcagggcttttagcggcaattggatggctgaaccgaaccacggtggaagcagttcagaaaaaagaagagaaactgttaaggttattttatgaaaatgcaaaagaaattccgaagattcatttttatggcagacctccagaagagggggtaccgcatctacctgtgcttgctttaaatttgggaaatttggattctgcttatgtcagtgatattctcgcagaagaatatgaaatttacacgagagcaggagcacattgtgcacctttgatgcatcaggcgttgaaaaccgaaaaacaaggctgtgtgcgtttttctttttcctggtttaataccgaagaagaaattaagacagcggtaaacgccttaaaagagctgtcaagaggataaggcagaaatatccggtaaaagaaaggattttataagttatgaaaaaatacaggtcactggcaggaatgatattaggcttcctgctgcttgcctggatgtcaaagacgtgttatgcagagattgccgatgtaacagcatttgaaaatctggaatggaaaaaagtgcatgaagaagcgttgattgcacctcaaggtgttgttcagtcaatctgtgcaacaaaaaattatattatctgtattgaaaatacgaacgatgctcaggatacacctgacaccgtgtctgcttattataagaatgacacggatgcagatggaaatccggttgaacagtattcgcttgcgttaagaaatacggataataactgggaacatggaaatggaatggcctataatcaggcaaaagaagagatttatgttgctccttatacaagccagaatccggagaatcggggctgtctttttgtgatggatgccaatacactggcatataagggaaagattaaaatcagcgatgattataatatacttggaattggttatcgagaagaaacggatcaatatgtaatacagacgaacgtagaaggtggatatagttttaagattttagataatcagtttcagatagcagaggatcttgggagatatgagggaacttctgttggaacgaattttcaggatttacagttagtagatgaatatattctaaatttcccattgactttgaatatgggaattggagattatttaaacgtatattctcttgagacaaaagaattagtaagctgttctaaattgaattttccgtttgaaggtgtttccaatgatgagccagagggcttatgtgaaacggcagagggaacatatattgcagtcgtagatgaagatagaacagatggcaggcggatgttctgtttttatgaaacgcaagtgccctgcaaagaagaagcagtttcggcagaagaaaacatagatacaaacgaaaatgatgtaagggaatcaaaccgacagacaaaagcagatacactgagagaacggacagattcagaaaaaaataccgattcagaagaaataccgacgtcatctgaagattataaaaaagaagcatcaaagtctttaaaaaaacaaagcgcaaaaaatacaccgaaagaagtttcatttgcggaaaaaatgagcattggtttttctgggatgattacgcaggctcaagagttatcaaaaaaactgccttctgtagtgaaacttgcgaaagaagcgggaaatctggcaggggctttcatagaaactttattaacaaaaataaaaacattgtggaagtcaggttcaacaattctggcacagaatcagagaaaagtacttttatttcttgcaataggatttacaattataagcattatgggactctgggtctgtattgtccggctgattcgaatccgaaagcagaaaaaagcaagagcggaattagagcggcttagaaaagcatggaaagaagaggcagaacagtggcttcaggcagaaagaaagcgtctttgatgaaagaaagacgctttttagcattttaaccaaatcaaggaagtcccctgcttcaattgcaaaaagcaataagcaggggacttccttgtatcaggagggggtaagccccttctgataagctgcgcagcagctatttggttatgagcaagtagcgaaagcggattgcgaatatccgcttaacaatttaaaaagcggatttattttatttattatcccattcatcttttctaaaagaaacagaatcgtcggtcatagaatcaacaattgcgagggattctacacggatgccctgttcgcgaagagaatctccgccattctggaagcctttttcgattacgataccagcaccttctaagacagcaccagattcttttacgatttccattaatccctgtaatgcacatccatttgcaaggaaatcgtcaatgattaagacatgatcctcagtgcttaagaattttttggaaagaatcacgtcatatactcttttatgagtaaaagactgtacttttgtgcagtacatttctccatctaagtttaagctttgtgctttttttgcaaaaacaaccggaacattgaaatgctgtgcaacaagacaggcgattccaataccggaagcctcgattgtaagtattttagtaattggtgcatctgcaaatctgcgtttaaattcttttcctaattcattgataaatgggatatccatctgatgattcaggaaactatctactttaagaatatttccgggttttacgataccgtctttacgaatacgttcttctagtaactgcatgataaaaatcctccttaaatcttatacaacataatacgctattttatttgctttggcaaattgtttttcaaaatgttttgaaaaaaataataaaatttatataaaacgaaagaaaagaggagaaatcatgctataatagaaatattattgtgtagaaatttgagaggtttaaaacggttaagtgctatgaaagaatatgaagttattcatgaaatttttaatcagtgtccgggaaataagacaagagatcagtttattgaagaaattgaaattgaagagacaccggaagaatgggtcagaaaaaaattcaaaaatgagaaagaattccgacttgaaagagtagaaaaagaggatggaactttagtgattgatgtgatgactgccatgattcatcagcgatatacaatttccgaaatctagcagattccaaagtgttgtttttttacgggagtttggtataattagaaaagtggtgagaggagtattattatattatggaagaaaaaaaacaggttcacagtcatacccatactcacacattagaggatggaacggtggtaacacattcccacacccacagtcatacgcatacaaaggcagtgttaaaccggctttcacgtgcaatcggacatttggagtctattcgtcgtatggtagaagaaggcagggattgttccgaagtattgattcagctttcggcggtgaaggcagcaatcaacaataccggaaaagtcattcttcaggaccatattgaacattgtattgtggacgcggtggaaagtggagataaggaagctttagatgaattgaataaagcaattgaccgattcattaagtgacagagcaagaaataagtaaaggaaggaaagcgttatgagcgaaaacaaacagtgcagcagttcaagctgtgacaagaaaagctgtgagggatgcagcagtgcaaagaaaaataccatcccgaaagaggaattaaatgcatactctgcaattaaaaaagtagtcggagtagtcagtggaaagggtggagttggaaaatcttttgtaactgcgtctctggcaaatgaaatggcagcaaaaggataccgtgtaggtattttagatgcagatattacaggtccgtctatcccaagaatgtatggtttgaaaggtgcagcaatggcagatgacaatggaatttatccgatgctgacagaaaatgatattaaaattatgtctattaacttactgcttccgcaggaagattcaccggttatctggagaggaccggtcattgcaaatatggtaaaacagttctggaccgatgttgtctggggtgaactggattatttatttgtagatatgccgccgggaacaggagatgttccgttgactgtattccagtcacttccaattgatggaatcgtaattgtatcttctcctcaggatttggtacagatgattgtaaagaaagcttacaatatggctgaaatgatgaaaattcctgttgttggtctggtagaaaactacagctttgtaaaatgtccggactgtggaaaatcgatttatgtgtttggagagagcaaagcagatgaaatcggagcagagttaaacattccggtaatggcaaaaatgccgttagacccgaattttgcatctatggtggatgcaggaaaatttgcagaagtcagaaacgaatatctttctgatgcggtcaaatgtctgcctagagcgtaaaaataataagaaagtttggttagttaataagaaaatttaagtaaagagattgcaaaatagaaaaaaatgaataattggtataaccaaaaaataaaacagcaaaatgaaattaactaaaatacgaagcaaaacattacaattcttgaacaaaataacgaagaaagaacggagtttgattgagtttgaaaaaaaatgaagattgacaaatcgaaagaatactgtcataatacgtctaacaatcaaacaaggttgtgtgaaacaaagaacatttttttaaaattctaagaagaggtgacaacgatgacagagcgtcagattaaactttcccaaacagaagacgtaaaaaattttgtcagagcagccagtaaatgtaatttcgatattgatgttttttataatagaattgttgtggatgcgaaatcaattttaggcgtgttcagtttggatttaaaccgtacactgactgtaagatgtaatggcagtgatgacaaatttaatcaggtcttggaccagtttgcaatcgcataatcaaaagaatcaaagaagagaatcccttgcctgaaatcggataagggattcttttttcttgacctgtaagaaatacaaacgtataataaagaacagaaaacaggttttagagaggagactttaagatgaaagtagttagcacagaaaaagcaccagcagcaatcggaccatattcacaggcaatggttttaaacggagtggtatatacttccggacagattgcaattgacccggcagttggagatgttactgcaacaacaattgaaggacagtcagaacaggttatgaaaaaccttggtgaagtattgaaagcagcaggaagcagttatgagaaagcagtaaagacaacctgttttttagcagatatgggagacttcgcagcgtttaacgaaatctacggaaaatactttacaggaaaaccggcacgctcctgtgtagctgtaaaaacacttccaaaaaatgtactttgtgaagtagaagttattgcagaagtttaaaaaattaatttactaactaaaaaagaatatttgaacgcagataagcattcccccgcttcaagtgcgcggagcactaagcgacgggtgaggggggatgcttctgtcagtgggagttgaaagctcccactgacagatcgcaaagcgactgcgttcatgagcaagtagcgaagcggattgcgaatgttcgctttacaaaaagtgtaagagtgttcccttaaaaaagtttgggaatactctttttttatcccccctcggggcttgtgaagtaccaaatactttggtaaagtaaagtctcagaataataatgatgtatcaggaggtatgtatatcattaggaaagaggcgaggatttactatggcagaattattaaatcagatagaagagtactggagtaccagagtagagggatattcagaagtcaatgaaaaagagataaacggaacacagaaagagaattggcttcgggtgcttgaggaacgttttccggataaagcaaaagcagatttaaaaattttagatgtcggaaccggtcctggattttttccgaggattctttcagaagccggatattatgtgacagctgttgactacactgaggatatgttagagaaagcaaaagaaaatacaaaagaatatcaaagccagattgaattttatcgaatggatgcacagaatctggaatttgagaacaatcagttcgatgtagtgatttcaagaaatctgacctggaatctggaaaatccggtacaggcttacaaagaatggtttcgggtattaaaaacaggaggaatcattttaaatttcgatgcaaactggtatggctatctctatgatgaagaaaagagaatggcgtatgaaaaagatagggaaaatgtagagagaagtcagttagatgaccattatctttgtacagacattgaccgaatggaagaaattgcaaagaaagttccgctttctgcaaagaatcgtccaggctgggatgtggaagtcttaaaagaaattggttttgcagaaattcggacagatgaaagtatctggcagagcgtgtggagcgaagaagaacggttaaattatgcctcaacaccaatgtttttagtttcaggacagaaaggggaaaactagtttggaagcacagaagaattttaaaattggaacacttgaagtaaagccgggagaagcttatcatggaaagctggaactttcaaagggagcatttgaagtgccggtgtctgttttttgcggaaaacgaccgggacagacggtgttaattacagcgggagttcaggcaggggaatatgtaggaatccagtcagcgattgatttagcaagacatttacagatagagaaagtaaacggtacaatcattattgtgaaggtaatcagaaaagaagagtttgaacatcgtgccggaagtctgggagtcaaggatggaaagaatttaaatcgtgaatttccaggcaaggcagatggaacagagacagaacgtcttgcttatgcagtagcaacagagctgtttccttatgttgacaggtacattgatttacatagtggaaatgattatgagagattaactccttttgtttattatgcaggttgtgcaaaagaagaggttgtggcaatgtcgagaaagatggcagaacaggtcgatgtgccttatatggtacgttctgcggttgcaacaggtggtgcttataattatgctgcaagtatgggaattccaagtattttaattgagcgcggagaaatgggtgcatggacgttagaagaagcccgttctacaagaagagatgtaaaaaatattctttgtgcaattggaagctatgaggaaaaacgagattatcgacagtattatccgctggaggtagtagatgtgacttatcaggcagcagaatttacaggatgctggtatccgtttaaaaatccaggagatatgattgtaagaggagaagtgattggagaaatccgtgattatgaaggcaatcctttggaagtctgccgtgcggaatacgatggagtaattttatttgagacgggttctttgcaggtaaaagcaggaggttcagcaattacttatggacgaattgcgagaatatttgatgatagaaaagagcggattaccaagtattgggccaaacgaagcgagagctttttagagcaaagaagagcagagttgaaaagtgcactcgcagagcgatggataaaggaaattaagaaacagcttccggatggtaaaaaattaaaaatcttagatgtgggctgtggctctgggttcttctcaattttacttgccaaagagggtcatcaggtggttgggacagatttgacaccggagatggtagtaaatgcaaagaaacttgcgaaggaagaacaagtggaaccgacatttcttgtgatggatgcagaaaaattagaatttgaggatgcttcttttgacatgattatttcaaggaatctgacctggacgcttccacatgcagaagaagcctatcaggaatggaaacgtgttttaaagccgggtggaattttattaaattttgatgcgaattatggaaatgatgattgctcagatacttcagggcttcctaaaaatcatgcacattatacagtgggtgatgaattgctacaggaatgtgaagagataaaaaaacagcttccgattagttcttatgctcgtccggcatgggatttaaacgtacttggaaaggcaggattttctaagtttggaattgatttagaaatcagtagtagaatttatattgaaaaagatgaattttataatccaactccgttgtttatgttgtgttccaggaaaaaaatttgaacttaaaatgaatcaccttatgaaaaattggaatatcttgatatccccccagggggcttagagaaagattgagaaattgatatacttaatcttatacttgtaagatgaggtgataaagtgaaaaaatatgtattaaaaagattattacagttaatccccattttattggggattacttttttgtcttttgcgatgatgcgtgtcgccggttcggatgctgtaacagagctttatacgaatcgtgggacagaagtctctcaggagataattgatgcaagaagagcagaacttggactggataaaccatttctgatacagtattttagctggcttggaggaatgttgaccggagatatgggacaaagttatgtcagtggtgcagatgtgttttctacatttctttcaaaactcccggcgactttgcttttgacaggattatcaattgctttgacagttattatctcaattcctctggggattttttcagcaatgaaacaggataggattcctgatttattgcttcggttttgtagttttattggaaatgcattgccgaatttttttgttgcaatgcttttcatgcagttattcagtattaaattaaaactgctgccggttatttcagacggggtgaatctaaaaagtgcgctgctgccggctttgactctggcagtttccatgtcggcaaagtatatgcgtcaggtgcgagcaacggtacttgaggaatggaataaagattatgtgcaaggagcaatggcaagagggataagaaagaagattatcctttggaagaatgtgatgaaatcttctatgttaacgattgtcacacttttagcactctcaataggaagccttttaggcggaacggcaatcattgaaagtatttttatgtgggatggagttggaaaactggcagtggatgcaattacgatgcgagattatccatttatacaggcttatgtagtctggatggcagttatttatgttctggttaatttgattacagaccttatgtaccatcagcttgacccaagaattcgtttgggggtgacaagagaatgaaagagccgacagtaagaatgcagaagatacatagaaaccatttgaagttacgcttaatcatatttggaggtttggcactggctttagtcattgcttcgtatttcagtgaatcattatgcccttatgacccgtatttacaggatttgggcaatgcaaaagcaattccgtcagcagcgcatttatttggtacggaccggtatggaagggatatgctttcccgtgttattgtggggagtaagaccagtatttattctactttattattggtaggatttattatggtgtttggcacaatgattggaatcttctgtgcatggagcggaaaaaaaatagattctgttttgatgcgtatttcagatatttttctggcttttccgggtctggtgtttgctttggctgtggcagcagcgcttggcggtggagttcacaatgcgattattgcacttgcggccatcagctggccaaagtatgcgcgtgttgcaaggagtcagacgctggcacaaaaagaaacagtttatataaaagctgccaggttatcgggatgtgggactggaaaaataattttaaagcatattcttccgaacatctttggtccgattctggttacggcagtattagatatcggtacgatgatgatggaactggcaggtctttcctttttggggcttggagcaaagccgccgattgcagaatggggaagcatgatgagtgatacaagaaaccttttaacgactcatccatgggtaacactggctcccggttttgcaatctttgtatcggttgtgatttttaacttacttggggatacggtacgagactggttagaccctcgaaatgggaggtagaaaagaatgtcggaaatcattcgatatgaacatgtagatatcagctacaaaggagaacttgcagtacatgatgtgagcttttcagtggaagaaggagagattcttggaattgtaggagaaagcggtagtggaaagtccactttgataaaagctgcgatgggtttgcttggaaaagacggactggtgacaagaggagatatctggtatcagggtctcaacctgccagatttaaagccaaaagaaatgagaaaaatctgcggtcctgaaattgggatgatttttcagatggcgggcagttctttttgtccaattcgtacggttcgggcacagctttatgaaagtgtaagagagcatgaaaagctgacaaaggcagaatttgaagtacaggtgacagagttatttgaaaaatttggatttgatgacccgaaacgaatcttggacagttatccgtttgaactttcaggagggatgcagcaaagagttggaattgtagcggcaatgttgttaaatccgaagattctgatggcagatgaaccaacctctgcgcttgatgtatcggtacaaaagcaggtagttgatgagatgtgcatggtacgtgaaaagtttggaacaacgattttactggtgacgcataaccttggagtaattcgagcaatggctgataaggtactggtacttgaaaacggagaagtaagagagtatggaaaaaccaaagaagttttggaaaatccacaatcggaatatacaaaaaaattgttgtcagcagtattagaacttcggaggtaaaagcagggtggattgtattttaaaagtagaacatttgacgaaaacgtttgtctctcagggcagagatgattacacggctgttgatgaggtgagcttttctatgaattatggagagaagctcgcgattataggagaaagtggaagtggaaagacaacaatcgtaaatatgataaccagattgttggatgtaacctctggaaccgtttatctggatggagaagagattacaaatttaagtggtaaaaaattaaagccagtttataaaaaaatgcagatggtgtttcagactccgacagaaagctttgacccgagacagactcttggagatggagtggcagagagcttaatcaatcatggcatgaaaagaaaagaagccataaaagaggcagaaaatttgctggagttatgcggattaaaaaaagaatttgcaaagcgatatccgcatgaagtcagtggaggacagtgtcagagagcagccattgcgcgggcaattgcgattaaacctaaattgcttattttagatgaagcgacttctgcacttgacgtaactgtccagaaagaaatcctggagttattggaacggttaagagaagagcgtaagatgtcctatctttttatctgccatgatattgcactggttcaaaacttctgcgacagagtgcttgtgatgcatcagggcaaaataatagaagaaggaagttcagatgaagtaatccgtcacccgaaagaagcttataccagaaggctgatagagagcgttctgtaagatataagaaaaataaacaaaaggaaagggaaaaggaatgaacaaatcgaaaaaaataattggaatggcattaagtgcatgtttgtgtgttagtatgcttgccggatgtggaagtaataataaaacagaaacatcaaaaagtgattcaaaaacagaaaattcagaaacaaaaaaaacaatggtaattggagataccacattcaacagttccaatgaagagaacagtacaaatccacatgacgcatattccggatgggcatgcatccgttatggaattggggagactcttgtaaaatattccgataatatggagattcagccatggcttgcgaaagaatgggaaaatgtagatgagctgacctggaagattacacttcaggacaatgtaaagttttcaagcggacgagatatggatgcagaggcagtgaaacagtgtctggaacatttaattgaaaatcatgacagagcgaaaaatgatttgaaaattgcatctattgatgcagatggacaagtacttacaattcatacgtctgaaccaaaaccggcacttttaaattatctgggagacccttatggctgtattatcgatgtagatgccggatttgaaaatggaattgttgcaggaacgggaccttacattgcagttgattgtaaaacagatgaccatctgacattggtaaaaaatgagaattactggaatggagagccaaagattgatgaattgacgattcgtacaattaccgatggaaatacactggcaaatgcacttttgtccggagaggtgcaggcagcttatggtatggcatatgaaagttatccgacatttgaaaatgataatttccagttttcacagatttccacttcccgctgtttctttggtaagatgaattttgatgaatcctctgtgtgtgcagattcagcagtcagaaaagcaattgcgatgggaattgataaagaaagttttgtaaccacattgttggaaggcaacggttatccggcaaatggagtatttccggaaggctctgcgtttgggggagataaagttacaacggaaagttatgatccggaaggagcaaaaaaagtcttagaagaagccggatggaaagattcagatggagatggaatccgtgaaaaagatggaaagaaactggttgttaaatggctgacttatccaagtcgtcaggaacttccacttctggctgagtctgtgcaggcaacattaaaagacattggaattgaagtagatattaactgtaccgcagataataattctatattggaagatccgacagcctgggatgtttatgcgatggcaaatgtacaggctccaactggagacccggaatactggtttactgtatttgcaacttctgatgcaacaaagaattcaggaaaatacagcagtgcaaaattagatgaattagaatcacagttaagtaaagaatttgatgaggataagcgagcagagttagccgttcagatgcagcagactattttggatgataatgcctttgtattttgttcgtttttaaagatgagcatgatttcacgttcaaatgtaacaggatatgaatctcatgcctgtgattattatcaggtaaccgcagaccttgatataaactaaaatattgtattgcaaaagtggatattccgtaggggatatccatttttgtccttgtgaaaatttgatgactttggtatgattttaaaaagcaatgagaaaaagcgaggaaaaagaaaatgcttgagacaaaacagctacagtattttgtagtatcagcggattgtggttcttttcgtgaagcagcaaaaattttatatacaacgcagtctaatgtcagcaaggtgattgcggggcttgagagtcaggtcggatatcctttgtttttgagagataggaagggaatcgttgttacttcaaggggaaaaatgttttatcagcaggcacgcagtttgttagaacaattacagaatttagaagatgagagtgaagaacacagtctggaagtggtaagaatttctaccaatccaagttcctggttttcggaatatttttcggaattttatgaagcacataaagaagaacagattcgctataatattcatacggatacgactttaaacatcgtgcagagaatgagaaaaatggaagacgagattggatttgtctatgtgatgccgggtgatgtcctgcggtttgaatatgaattgaaaaaatatcagctggaatttgaagttttaagcgaaacgtttggaatgttgtatttttctgctgaaaactggattaaagaagaaaaaccggacttacatttattaagtgaggtgaaactgattcaggctgaaaaagatccatttcggaaatattcagcctggaagattaaagaaaatggggaacaaatcctgccctgtcaggttgcagttacaacaaacagtgattatattatgaatattatgatgaaaaaaaaccatcttgcaaatatcagttcgagaagctttcacgtctatccgttgggagaagaaccaggttacgtgttgtctgccaaagagggaaaaattttatacggaataataagaaatcggaatgtctcccgaaatcctctcattgaagagatgatagaaaagattcgggagaaaattaatcaggaaaagtaatttaaaaattcttttgctgctgcagacgggatctgaggatggtaagccagaaccagatgacgctgtggcagtttttcttttatctgaagtggatatagatcttcgtgcctctgctgtaaaacaaaatccggaacgaaggcaattccaagaccgattcttgcaaggtcaagcaggagatcattgctggaaagttctacttcgggatttaaatttaagctcttttgtaaaaataaagagtgaagaaattcactggtggtactttttttatcaagcattaaaatcgggtactcgtgcaggtcaaacagggagagtttctgctcggtaaaatcaaagtattttttgttggcagcaaacacatcctgaaaggtaaaaatggttttgtaatttgtgtgaagctgtaacttggaattaggatagttacaaaaagcaaagtcaatctgatgatgttctaaaagttctgcgcatccaatcgaagtagcattggtgaccttgattgtgacttgtggaaattccttgtgaaaacgctgtaagtaagggacaagaaaataacggcagatcgtatcggaagcaccgatgcgaagcggtgtttctaaggtatttgtgccgattaactgtcgttctccctgaaccaaaagattaacggcaggctcaacatggcgaaacaatgtttctccttctggagtcagcatgacacacttggtgttgcgggtaaagagtttatgtccgagtttttgttctaatgatttgatggactggctgactgctgactgtgaaatgtacagttgtctggaggcttcagaaaaacttaaggtagaagcaacgtaataaaaaactttgtaaagttcaaaactgatatccatggaaaaacctctctaaaaaaatgattgatacaaacagtataacaaagagaaaaatcagcgtcaaactatttattatctgaacttattaaaaatataagatatattaattttattaataaaaatttctgtggtatgatgaacatagaaatgcgaaagataacaaaaagatgccctttatggcggtttttatcagaaaggagttatttatgagcagtgtaagacgtgtgtacgttgagaaaaaaccagattttgcagtacaggcgaaagaattaaaacatgaaatttcaagctaccttggcatcaaggatgtaacaggagttcgggtgttaatccgctatgatgtggagaatatttccgatgaggcatttgaaaaagcctgtacctgtgtattctctgaaccaccggtagattttttatatcaggaaacatttgagacaaaagagggagatcagtcgttctctgttgaatttcttccgggacagttcgatcagagagcagactccgcagtacagtgcgtacagttcttaaaagcagatgagaaaccgattattcgttctgcaactacttatgtaattgaaggcggtatttcagcagaagaaatggaagcaattaaaaatcactgcattaacccagttgattcgagagaagctgatgcaaagaaaccggaaactctggttacgaattttgaagagccggcagatgtaaaaatctttaccggattttctgatatgaaagaagaggaattaaaagcactttatgaatctttaaatctggctatgacctttaaagatttcgaacatattcagaattattttaaaaacgaagagaaacgcgatccgtctatgacagagattcgtgtgttagatacttactggtctgatcattgtcgtcatactacgttctctacagaactgaaaaatgtagagtttggagagggcgattataaaactccaatcgtaaaaacttatgaaaaatatctggcagaccgtcaggtgatttataaagacagagatgataaatttgtctgcttaatggatcttgcactgatggcaatgaagaaattaaaagcagaaggcaaacttcaagaccaggaagaatccgatgaaatcaatgcctgcagtattgttgttccggttgatgtagacggaaaagaagaagaatggttaattaactttaaaaacgagacccataaccatccgacagaaatcgaaccatttggtggtgcagcaacctgccttggtggtgcaatccgtgacccgctttccggtcgtacttatgtttatcaggcaatgcgtgtgacaggagcagcagacccgactgtatcagtaaaagagaccatgaaaggaaaacttcctcagaaaaaactggtaagaagtgctgcacatggttattcttcttacggtaaccagattggtcttgcaaccggttatgttaaagaaatttatcatccaaactatgtggcaaaacgtatggaaatcggagccgtacttggtgcagcaccaagacgtgccgttatccgtgaaaattctgatccggatgatattattgtattattaggtggacgcaccggacgtgacggatgcggtggtgcaaccggttcttctaaggtacataccgaagaatcgattgaaacctgtggagcagaagtacagaaaggaaatgctccgacggaaagaaagattcagagactctttagaagagaagaagtcagccatattattaaaaaatgcaatgactttggtgcaggcggtgtttctgttgcaatcggagaacttgccgatggtttaaaaattgatttggataaagtaccgaaaaaatacgcaggtctggatggaacagaaattgcaatttctgaatctcaggaacgtatggcagttgtagttgacccgaaagatgtagaacagttcttaagctatgcaaaagaagaaaacttagaggcaattccggttgcagttgtaacaaaaagcccacgtctggtaatgagctggagaggaaaaacaattgtagatttatcaagagcgttcctggataccaacggtgcacatcaggaaacagatgttttcgttgatgtaccgactaaagaaggaaatgtattagaccgtgcagaagtagacgatataagagcacgctggattgatactttaggtgatttaaatacctgttctcaaaaaggactggttgaaatgtttgacggctctatcggtgcaggcagcgtatttatgccttatggtggaaaatatcagttgactgaaacacaggcaatggttgcaaaagtgccggttatgaatggaaaaacggaaactgtgacaatgatgagttatggatttgacccatatctgtcaagctggagcccatatcacggtgcagtttacgcagtaacagaatctgttgcaagaattgttgcagcaggcggtgattacagcaagattcgtttcaccttccaggaatatttcagaagaatgacagaagataaacatcgttggagtcagccgtttgcagctttactcggtgcttatgctgcacagcttggatttggacttccatctattggtggaaaggattccatgtccggaacctttaatgagattgatgtacctccgacacttgtttcctttgctgtcgatgtagcaaaagaaaaagatgttatcacaccagaactgaaaaaagccggaaataaattagtatggcttcgtatgccaaaagcagagtatgatttaccggattttgaagccttaaaagtacagtatgcgaaactgcatgaagacattcaggcaggcagagttgtttctgcttatgcgttagaccgtcatggtattgcagcagcagtcagtaaaatggcatttggtaatcagatgggtgtaagaattgaatcgaatgtagatgaaagagatttatttaccgcaggttttggcgatattatttgtgaagtaaaagatggaaaagttggcgaactggcaattacttatactgtaatcggtgaagtaacagataaagcagaaattgaatataaaaacatgaagatttctatggcagaagcactggaaacctggaaagctccactggaaaaagtatttaagacccgttccggttctgagacagatgatattacaaagaaagaagacagaggcttatataaagcagacagtatccatatctgctctcataagattgcacagccaaccgtatttattccagtgttcccaggaacaaactgtgaatacgacagtgcaaaagcatttgaacgtgcaggtgcgaaagtgattacgaaagtattcaagaacttagatgcagcggatattcatgattctgttgatatctttgaaaaagcaatcgaccaggctcagattattatgttcccgggcggattctccgcaggtgatgaaccagatggttctgcaaaattctttgcaactgcattccagaatgcaaaaatcaaagatgcagtaaccagacttgtaaatgagcgtgacggacttgcacttggtatctgtaatggattccaggctctgattaaactgggacttgtaccaaacggtgcaattacaggacagaatacagattctccgacactgacctttaataccatcggacgccatatctctaagatggtttatacaaaagttgtttccaataaatctccatggctgcaaaaagcagaactcggaaaagtatacactaatccggcttcccatggagaaggacgttttgttgcaaatgaagagtggttaaagaaattgtttgaaaacggacaggtagccacccagtattgtgatttagcaggtaatatcacaatggatgaagaatggaatgtaaatggttcttatgcatccatcgaaggtattacaagtccggatggacgtatcttaggtaagatggctcattctgaaagacgtggagatggcgttgcaatgaatatttatggagaacaggatattcagatctttgaatccggtgtagaatatttcaaataagataaagtttggaacacaaaattccgctttatataaaacaaaaatcattccttaaatttaaattaagaaagatcgttgcagagccggtcggctctacagcggtcttttttgtcggttagaaattgtactttgaaaataaaaatataaagaaaatcaggataaaaaattagaaaatatcgcaactattagaaaaataaaaaaaattcaaaaaaagtgttgacatttcgactcatttaaggttataatagcagagcagtcaggtaatggctgttaacgaaatgggatcttagctcagctgggagagcatctgccttacaagcagagggtcacaggttcgagccctgtaggtcccattccttttgaaaaaaacaaaagaaataaaaaaagatggcgagatagctcagttggctagagcatacggttcatacccgtagtgtcgagggttcgaatccccctctcgctacttggtcaaaagaccaaaaaagaaaatgggatcttagctcagctgggagagcatctgccttacaagcagagggtcacaggttcgagccctgtaggtcccattccttttgaaaaaaacaaaagaaacaaaaaaagatggcgagatagctcagttggctagagcatacggttcatacccgtagtgtcgagggttcgaatccccctctcgctacttggtcgaaagaccagagattaaatgggatcttagctcagctgggagagcatctgccttacaagcagagggtcacaggttcgagccctgtaggtcccatttcttttgctaaaaaaacagaagaaagaaatgaaaatgtggcgagatagctcagttggctagagcatacggttcatacccgtagtgtcgagggttcgaatccccctctcgctactctttttttatccatttttacatttttaaagaatcatatgcagaacagtgcaaatggttcttttttgttgtacaataaagaaaaactaaaaaatagggaaggaaggtaaaaataaaatgctggaaaacaaaagctcaaattatgataaattaagcgaagaatggcggttgaaatttctggagatggataaagaattagtgaagaaaaaacttccggaaatcagacaggaaaatgatatgttttttattacacattttggagaacagtatggtatttctttaaaagacggaacgatttttttggtaaatcaaagagaaaagccggtgtcaaatggagtaaagatggatatctataacttattctggtattctaaagaagatgcctttttcatgaaccgctgggtcccttttcgggatgtaagaggtgcttctccctttacaccggcatttgagagaaatgtgcttatgccgtttgcaaagacgtttgaaggacatacagaagaattaaaaaaggcagcggaagcaattggaggaacaagtgtgaaacaaggcgatgtcggatatatcattcctgcatttgactgtattccgatgcagtatttattttgggatggagacgatgaattttcagcacaggcaaatattttatatgattatagtgtgacggattatattcatgtagaatctacggtatcccttgcgacagaaggaattttaagactggcagaaacagcaggtttggaactaaagggaaatatttttagaatgtaaaagtagaatcccctggatagggttaaaaaagtaaaaaaaagaataaaaacagtgaattttcaaggcttgaaaaaaatgaaagtaaaatccccccaggtggcttgcgaagtagaaaaagacagggtattatgaattcaaggttatgaaattcgtcttcctcttttacgaataaccttaactttacagtattgttggacttgtagaatacctctgcaaaaactacaaatcctctaagaatttcgttgaaaaagaattccgtacgataaaatgtatgggattcttttttcttgtaaaggaaaaaggaattcgatacaataaaagaaaacagtaagggagaaaaagtaaatgcaaaaagaacaaaaatggcttgactgggcggtggaattacagagtcttgcgcagagtgccctgtattattgtaaagataagtttgatatagaacgttttgagcggattcgggaaatttccgcagagatgttaagtgaagcgtcaggacttccgacagaaaaagtaaaagaaatcttttgcaatgaagtgggatttcagacgccaaaattagactgtcgggcagcaatctttaaaggggataagattttacttgtgcaggaaaataataagacatggtcactgccaggaggctgggttgatgtagaccagtctgtcaaacaaaatacgataaaagaagtaaaagaagaagcgggactggatgtgacagcggaccgtgtgattgcagtgcaggacagagagaagcataatctgccgatttatgcttataaagtatgtaaaatttttgtacagtgcagtgtaatcggcggagcatttcaggaaaatattgaaaccatacagagtcgatatttttcactggatgaactgccaccgcttgcagaagaaaaaaatacaaaagaacagattgagatgtgttttcaggcgtatcgttccaaagattgggagacaatgtttgattaaaagttataaattagtggcgaaaccccataagcttgcctgtgggagtagtcagcaactggaataaattttaaaacaacttgtcaataccaccatacaagttataaaataaaaaccaaaggagtgtgtatagtggcaaacgaaaatggaaagacaaaatattatgcactgatggaagaattaaaacaggcgattttaagtggtcagattaaaccgggagagaaacttccatccgaaaatgagctgtctgcccgttatcaaatcagtcgtcacacagtccggaaagcactgtctattttgattaatgagggatatattgaggcagaacatggcaggggaacattttgttctcagagaatgggacatttgaagaactcaagaaatgtggcagttgtgacgacttatatctcagattatatttttccgcgtctgattcaagggatggataaggtactgacggaaaatggttacagtattattctgaaaaatacagcaaacagcagaacaaaagaagaaaaagtgcttgaagatattttgacaaaagatattgaagggctgattatcgagccgagtaagagccagattttctgcaggcatacgaacttgtatggtatgctggatgagtatgaaattccttatgtttttattcagggtgtatattcccagatgttggataaaccacatatattaatggatgactgcaagggcgggtatatggtgacaaaacatctgttagattatgggcataagaaaattttaggtatttttaaggcagatgattctcaggggagagaacggcataagggatatgtaaaagcattgcaggaagcaggaattgcttatgacccggatatggtggtatggtttcatacagaggacagaaagacaaaaccaggaatgattatggaactgttgttaaagcagaaaaaagagatggacggaatcgtctgttataatgaccagattgcgcttgaagtcatttactgtctgaaaaaaaatggagtccaggttccgacagatatctcagttacgggatatgataattctgtaatcggagagggaatgggaggtctgacaaccattacgcatccacaggaaaaactcggtgaaatggcagcggaattactgcttgaaaaaattcgaaaaatcccggaagaaaaaagtaagattccgagattgatcgaaccggaattaattgttcgaggttcaacgagaaatagaaatcaaaaataaaagaaacacgaaaaagaaagtgaggacaaaagaatgttagaagaattaaaaaaagcggtatacgaagcaaatatgcttttacctaaacacggactggttacatttacctggggaaatgtcagccagattgacagagaaaccggatattttgcaatcaaaccaagtggtgtggattatgataaactgacaccggaagatatggttattatggatttagaaggaaataaaatcgaaggaagatacaatccgtcttctgataccccaactcatctggagttatacaaagcatttccaaacattggcggtgtcgtacatacgcattcttcatgggcaacaagctgggctcaggcaggacgtggaattccatgttatggaacaacccatgccgactatatgtatggagaaattccatgtgtcagatgtctgacaagagaagaaattgaaggtgcttatgagaaaaatacaggacttctgattgcagattactttaaagataaagattatgaagcagtgccggcagtactttgtaaaaatcacggaccgtttacctggggaaaagatggacatgaagcagtacataatgcagtcgtattagaagaagtcgcaaaaatggcagcacgttgtgaaatgattaatccgcaggtaaaaccagccccacaggaactgcaggataaacattattacagaaaacatggtgcaaatgcttattacggacagaaataaattttggatataaaaattccgagaatatagaatgaaaaacggaggaaacaaaaatgggtttcgatgcaaaaagcgtaattgaaaacggaaaagcagtacttggtattgaatttggttcaaccagaattaaagcagttttaatcggagaaaataatgaaccgattgcttccggtgcacatgactgggaaaaccgtctggagaacaatatctggacttacacattagaagatatctggacaggtcttcaggatagttataaaaaaatgacagaagatgtcaaagaaaaatacggagtagaagtaaagaaactggctgctcttggatttagtgcgatgatgcacggttatatggcatttaatgaaagcgatgagctcttagtaccgttccgtacctggagaaataccatgacacagcaggcatctgatgagctgactgaattatttcagtttaatattccacagagatggagcattgcacatctttatcaggcaatgttgaataaagaagaacatgtatctaaaattaaattccagactacgcttgcaggttatattcactggaaactgacaggaaagaaagtacttggtgtaggcgaagcttccgggatgtttccgattgatatgaatacaaaaacctacaatgcaacaatggtagaaaaattcaatgaaaaagtggctgaaaaaggatacagctggaaattagaagaaatctttccggaagtattaagcgcaggagatgcagcaggtgttttaacagaagaaggtgcaaaactgcttgatacgacaggaacattggaagcaggtgtgccggtatgccctccggaaggagatgcaggaacaggtatgactgcaacaaacagtatcgcaaaacgtaccggtaacgtatctgccggaacttctgtgtttgctatggtagtactcgaaaaagaattatccaaagtatataaagaaatcgatatggtgactactccgacaggaagtccggttgccatggtgcactgcaacaactgtacttctgacttaaatgcatgggttggactgttcaaagaatttgcagaagcatttggaatcgaagtggatatgaataaactgtttggaacattatataataaagcacttgaaggtgaaaaagactgtggcggacttttagcctacaactatttctcaggagaacatatcacaggatttgaagcgggtcgtccattatttgcacgtacgccggacagcaaattaagccttgcaaactttatgcgtgtgcatctgtatactgcacttggcgcattaaagacaggtttggatattttgttaaaagaagaaaacgtaaaactcgataagattcttggccacggtggtctgtttaagacaaaaggtgtgggacagaagattatggcaggtgcagtcggtgttccggtatctgttatggaaaccgcaggagaaggcggggcatggggaattgcccttcttgcctcttatatggttaacaaagcagaaaatgaaacattagatgattatctgaataataaagtatttgccggaaatgcaggaagtgaaatggaaccagatgcagaagatgtaaaaggatttgatgcatttattgaacgttacaaaaaaggacttccgattgaacgtgcagcagtagaaaacttacagtaacaaatagcagaactcacagggataaaaaaatccctgtgagttttttaatatagaataatttatccaatcaacgcgagaatgtaaaaaaatatttaaaaaaaactattgacagaaataggataattgtgtatactaatcacagttagataaagctaaccaacaacacacacactacatacacaggcggctgtaaagacagtcgccaaaaaaagagaatggagttagaaaggactaactttaaatagaaaattgatataaaccactaaaaactgttttgaaaggagaattaaaatgagtattgttattgtgggcggaaatgagagaatggtctgtcagtatcagaatatctgtaaaaactacggctgtaaggcaaaggtatttgcaaaagaaaaaggcgctatgaaaaagaaactgggctgtccggatttgatgattttgtttacaaatacagtatctcataagatggtgaacagcgcattgcaagaagcgaagaagaataatattccgattgcgagaatccatacaagcagtgcagccgctttacacacagtactgaacgaatatacaggaaaggaaagtgtagtatgctagaacagtatctggtggagcattgttcgccaacccttgccggattaaagacggcgaatcttttttcagttcgttttattgatgaagaagagttaaatcagcatatgaaacagtgtgaaaaaaaatttcagaataagggagtctcattgattctcttgaaaaaaagagctgatacggcattgatttatgtatgcagaagagagaaacttcaaaaagatttacagaaaaacggtgtaaaagaatttctaaaaaagtatggatatgaaaatactgatgaagaagaggccattgcgtgtttaaaggcacgattaaatttagaagaaaaattccctcatgaaattggactgtttcttggctatccgcttggcgacgttattggatttatcgagaacgcaggaaaaaacagtaaatgtgcaggttgctggaaagtttactgtaatgagtgtgaaacaatgaaattgtttgagaagtttaaaaagtgtacaaggatttacacaaaactttggagacagggtacaagtgtagaaaaactaacagtggcagcttaaaaagaaaaaaggagacgaagaaatcatgagtaaaattgcagttgtatattggagtggaacaggtaatacagaagctatggcagaggaagttgcaaatggagcaaaagctgcaggcgcagaagtagaatcctttacaacagatgattttgctgcagataaaatgaatgattacgatgcagttgcatttggatgcccggctatgggagatgaagtattagaagaggacgaattcggaccattatttgaggactgtaaagcaaaactttccggtaaaaaaattgctctgttcggttcttacggatggggagacggagaatggatgagaaattgggaagaagactgcaaaacagcaggtgcaatacttgcctgtgacccggttatctgtaatgatgaaccagatgatgacgcaaaagaagcttgccagaaccttggaaaagcacttgcataaataaattcaagaagaaatataacaaatacaagaaatataaccaaatagaatcaaaataaaaaataaaatataacgtaaaaagaataaagagaagagaagcgaaagtggagtagaagtgttgacttttactctgctttttgctatgttcaaagaaaactaaaaaaggagaacttcaaaaagatgatgcgtgtaggaatgggatatgatgtacacaaactggtagaaggacgcgacctgattcttggtggtgttaagattgattgggaaaaggggctgcttggacattcagatgcagatgtgcttttacatgcgattatggatgcacttttaggtgcagcagcccttggagatatcggacggcattttccggataccgatgagaaatataaaggaatttcaagtattaagttattacagcatgtaggggcattgttagaagagaatatgtacgtgattaataacattgatgcaacgattattgcacagaagccaaagatgatgccgcatattgaaaaaatgcgggaaaatgtggccaaagctctgaatattgaaaaaaatcaggtcaatatcaaggcaacaacagaagagggacttggatttaccggaagtggagaaggtatttcttcacaggcaatctgtgcacttcaagatgccagggatttcatggcagatgaccgtataatgccggcaggatgcggtgcatgctgtaaaaaaaattaaaaggtacgtcaggagttttggcgcacataaaaaacatcaggagaaaaagaaagtatgagtatattaaacgtagaacatttatcccatggatttggtgacagggcgatttttcaggatgtgtcctttcgtctgttaaagggggagcatatcgggcttgtcggagcaaatggagagggaaagtctacctttatgaatattataaccggaaagttgatgccggatgagggaaaaattgaatgggcaaagaatgtaagagtcggatatctggaccagcatacggtgcttgaaaagggcatgacaatccgtgacgtcttaaagtctgcgtttggatggctgtttgaaatggaagaacagatgaatggaatctgcgataagatgggggaagcatctgaagaagagttaactcagatgatggaagaacttggaacaattcaggatatgcttacgatgcatgacttttatattattgattctaagctagaagaagtggcaagagcacttgggcttacagaaatcggtctggataaggatgtgacggatttaagcggtggtcagagaacaaaagtattgttaggcaaactgctattggaaaagccggatattttgcttttggacgagcctacgaactatctggatgtggtgcatattgaatggctgaaacgttatctgcaggagtatgaaaatgccttcgtgttaatttcacatgatattccatttttaaatcaggtcatcaatctgatttatcacatggataaccagcagttaacacgatatgtgggcgattatgaccattttcaggaagtttatgcagtaaagaaagcacagcttgaagcagcttatcagaaacaacagcaggaaattagtgaattaaaagattttgtggcaagaaataaagcaagagtggcaaccagaaatatggcaatgtccagacagaagaaattagataaaatggatgttattgaactggcaagagagaaaccaaagccggaatttcagtttaagactgcaagaacaccaagtcgttttgtggtagagacgaaagaattggtgattggatatgacgaaccgctttccaaaccgcttaccttgacggtagagagaggtgaaaagattgctttagccggcgcaaacggaattggaaagactacgcttttaaagagtattttgggactcattccggcacttggcggaaaagcagtgcttggagattatctggagattggatattttgagcaggaaatgccacagggaaataagcatacctgtatcgaggaaatctgggaagaatttccgtcttatacacagtatgaggtaagagcctcacttgcaaaatgcgggctgacgacaaaacacattgaaagcctggtacgagtcttaagtggtggagagcaggcaaaggtgcgtttatgcaaaattattaaccgtgagacgaacctgcttgtacttgatgagccgaccaatcatctggatgtagatgcaaaagaagaacttaaacgtgcgcttaaagaatacaaaggaacaattttgatggtctgccatgaaccggagttttacgaaggactggtttcaaaggtctgggactgctcggagtggaccacgaaaattggctgaatcaaatgccggactttatgtaaaaagtgctttaaatcgacaaagtatatgcagtttttataaaaaaccactgcaaatttcgtcataaaaccgatgatttctccaaaaactacgaaaaatatgaaagaaataaaatttcagcttgcaaaatctgtccaagagttttataatcaatttgagtttacaaatagcgaaaatgaatcaatattaggaggacagaaagtcatgtcatacgtagatgaggttattgaatcagttgtaaagaaaaacccaggcgaaccggagtttcatcaggcagtaaaagaagtacttgaatctttaaaaccggttgtagaagcaaacgaagaaaaatatcgtaaagaagctttattagagcgtcttgtagaaccggaacgtgttattatgttccgtgtaccgtgggttgatgacaaaggtaatgtacaggtaaacaaaggatatcgtgtacagttcaacagtgcaatcggaccatacaaaggtggtctgagattccatccatccgtatatcttggaatcattaaattccttggatttgaacagattttcaaaaactcccttacaggtctgccaatcggtggtggtaaaggtggttctgatttcgatccgaaaggaaaatcagacagagaagttatggcattctgccagagctttatgacagaactttccagacacattggcgctgatacagacgtaccggctggtgatatcggtgtaggcggaagagaaatcggatatctgtttggacagtataagagaatccgtgattcttacgaaggtgtactgacaggaaaaggtcttacatttggtggttctttagttcgtacacaggcgacaggatatggtctgttatacttaacagaagaactgttaaaattaaatggaaaagaccttgctggtaaaacagtagctgtttccggtgcaggaaacgttgcaatctatgcaattgaaaaagcatatcagttaggtgcaaaaccagtaacctgctctgattccacaggatggatttacgatgcagaaggtatcgacttagaagcattaaaagaaattaaagaagtaaaacgtgcacgtttaacagaatacttaaactacagaccaaacgctgaatatcatgaaggcaaaggcgtatggagtgtaaaagtagatgtagctcttccttgtgcaacacagaacgaattacagttagaagatgcaaaacagttagtagctaacggatgcttcgcagtttgcgaaggtgctaatatgcctactacattagaagcaactcagtatctgcaggaaaatggtgtaatctttgcacctggtaaagctgcaaatgctggtggtgttgctacatctgctctggaaatgtctcagaacagtgaacgtttaagctggacatttgaagaagttgatgaaaaacttcagggaatcatggttaacatctgccacaacatggtaaatgctgctaagaaatatggtcatgaaggcaactacgtagtaggtgcaaatgctgccggatttgaaaaagttgcagaagctatgatggcacagggtatctgctaatcaaaatttggaaaataaattgctataaaaacagaaaaaccgtggcgtttaaaaaacgttgcggttttttcatctagtgaatccaaaagtagtttcggagtgaaatcaaaagtggttctgtgaaatagaggttgacaaatttgtcatttatgaataaactagaacaagacagattaagataaatttaagatataaaaaagcgatgaatggaaagagtaccacagaaattttttacagagaaagagggtcatcggctggaagccttctaaaaaggaatgtgtgaaagtgcctccagaagctgacagctaatccctgtccgtaatcctgcgttaaaggaagaaaagcggaggaatgtatcctcaagtagagtggaaccgcggaatatttcgtctctatatggcacaagtcatatagggatttttttatgagttaatttaagaataaacaaaaaagaagggaaagaaaatgggatttatcaagcatattaaagaagaattccaggtgattcaggaaagagacccggcgattaagacaccgctggaagtgctcttatatccaagctttcgtgttatgattcagtatcggaaagcgcataaactttaccagaatggacattattttcttgcaagatggatttctcaaagagcggcaagaaaaaccggaattgaaattcatccaggggcacagattggaaaagggctgtttattgaccatggaaacggtgttatcattggagagacagcaattattggagataatgttaccttatatcagggtgttacgcttggaggtaccggaaaagaaaccggaaaacgtcatcctacgttaagagataatgtaatggtgagtgcaggagcaaaagttatcggttcttttacgattggtgaaaattcaaaaattggagcaggaagtgtcgtacttgaagaagtaccgccaaactgtaccgtagtaggtgttccgggacgtattgtaaaaagagaaaacagaaaagtgccgagaagcgatatggatcagattcatttgccagacccggtattagaagatattcgtactttacagaaagaaaatgaagcgttaaaatccaaattacagagaatggaatatcagctgcaggagataagagaagaaaaggagaaaaacggattatgaaaatttataacacactgacaaagaaaaaagaagaatttgtaccgcttgaagaaggaaaagtaaaaatgtatgtgtgcggaccaacggtatacaactttattcatattggaaatgcacgtccgatgattgtattcgataccgtaagaagatatatggaatacaaaggctatgatgtaaactatgtttctaactttaccgatgtagatgataaaatcattgcaaaagcaattgaagaaggggtgtctgcggaagaaatctccaaacgttatattgcagaatgtaaaaaagatatggcagatatgaatgtaaaaccggctaccactcatccgctggcgactcaggaaatcgatggaatgattgacatgattcagactttaatcgaaaaaggatttgcttatgaggtgaatggaaccgtatacttccgagtaaagaattttaaagaatacggaaaactgtctcataaaaatctggaagatttacagtctggttttcgttccattcaggtatccggtgaaaatcagaaagaagaccctcttgatttcgtattgtggaaaccgaaaaaagacggagaaccattctgggtatctccatggggagaaggcagaccgggatggcacattgagtgctctgttatgtccaagaaatatttaggagaagaaattgatattcatgccggtggagaagatttagtattcccgcatcatgaaaatgaaattgcacagtctgagtgctgtaatggaaagcagtttgcaagatattggatgcataatgcatttttaaatattgacaatcgtaagatgtcaaaatctctgggtaacttttttaccgtacgtgaaatcggagaaaaatatgatttacaggtgcttcgtttctttatgctcaatgcgcattacagaagtccgttaaatttcagtgcagaattgatggaagcttccagcaatgccttagaacgtattgtaacctgcgtagagcagttaaaacattatttggaaaaagcagagggcaatgagtatgcagaagcagaaactgcgcttgtgaaagaagtagaagcgctggtggaaaaatatgaagaagcaatggaagatgatttcaatactgcagatgctattgcggctatttttgaaattgtaaaacttgcaaacacaaacacagatgcggaaagcacaaaggcatttgtacagttcttatttgataagattgtagggttaagtgatatcttaggattgattgtaaataagaaggaagaagtgttagatgaagaagtagaaaagctgattgaagaacgtcaggctgcaagaaaagcaaaagattttgcaaaagcagatgaaatccgtgacaaattagcagatatgggaattatcttaaaagataccagagaaggagtacaatggaagcgagcttaagttatttaaaagagctgtttgcactggggaatacggatattaagacgtattccccactgacactggcttatatcggcgatgccgtgtatgagattgttgttcgtacggttttggtagaaaaaggcaatgcacaagtcaataaactgcatcagagggcaagtaagctggtaaaggcttctgcgcagtctgaaatcattgaaaaattaaaagaggatctgacggaagaagaacttgccgtttataagagaggcagaaatgcgaaatcttatactatggcaaaaaatgcaactatgtctgattatcgaagagcaaccggatttgaagctctgatgggatatttatatctgaccgaacagtgggagcgaatgttacagttgattaaaaagggaattgaaaaaggagaaacggatggaagagaagttccaggaaagtaaagtagagggaagaaatgcagtattggaggcatttcgttccggtcgtgtaattgataaattatttgttcaggaacattgtgaggatggtccagtaagaacgattttacgagaagcaaaaaaacatgatacaatggtgcgttttgtaaaaaaagagcgcctagatcagatgtctgacactggaaaacatcagggtgtgattgcaatgacggctgcgtatgattatgcagaggtatcagatattttagaaaaggcaagagaaaagggtgaaccgccatttattattttattagataatattgaagacccgcataatcttggagcaattatccgtactgcaaatctggcaggtgcacatggagtcgttattcccaaaaaccgtgcggtcgggctgactgcgacagtggcaaggacttcggcaggggcattaaattatacaccggttgcaagagtgaccaatatggcaagaacaattgaagacttaaagaaagagggattgtggtttgtctgcgcagatatgggtggaacaaatatgtatgaccttgatttaaaaggtgcaattggtcttgtcattggaaatgaaggcgacggtgtatcaagagtagtaagagaaaaatgtgattttattgcttcgattcctatgaagggagacattgattctcttaatgcatcagttgcggcaggtgttctggcgtttgaaattgtaagacagagaatgtaaagaaaataaaaagatgaaagatttacaacaatatacggatgaagaattaattgtacagcttcgtaatggtaaccaaagcgtggaaacgtatctgctcaacaaatataaggggctggtcttaaaaaaggcacatgcgatgtttttagcaggtggagagacagaagatttgattcaggagggaatgattggactctttcaggcagtccgtgattatcagccggataaaaatacgctgttttcgacgtttgcaaatctctgcgtagtacggcagctttgtaaggcaatcgaagtttcaggaaggaaaaaacataaaccgctcaatgcgtatgtctctttaagtggagacgattctccacttttagaagcatttgatttcagccagcagaatccggaaacgattgtgattgacagagaaaatacggagcagatgcgtaataaaattcgggaatgtttaagcgaatttgaaaacgaggtgctggatttgtatcttgaaggaaagacttatacgcagattgcagtacttatggaaaaaacaccaaaatcaattgacaatgcactacagcgaatccgtggcaaaatcaaagaattgtcgctggattcgcgttaattgagaggactcataaaagaatctttgcattaacataaaaaataaaagaaatattacaaaaagtattgacatttcaaacaatttttgctagaatctgtaattgtgatgaacggcttgtgatatcacaagtcaggctgccttggctcagttggtagagcgtcgccttggtaaggcggaggtcggcggttcaaatccgctaggcagcttgtaaaaaacctctctgagatttcagagaggtttttttgaatgctttacaaataattaaaacgaatgccttttttaaatatagtattcaattgtttcgtgagatttcatattaaagatttcgtagactttatcacgaatcatcaggaaatcattggaagtacggtctctgtgttttggaagctgtaccgtaaggagagccttaattcgtccggggtttgcggacattatgacaattcggtcggcaagaaagacggcttcttcaatatcatgtgtgacaaagactacggtcttttttgtgtcctgtgcaatttccagaatgtctgtctgaagtttcattcgagtgatggcatccagtgcaccaaatggttcgtccataaataaaatatccggttctacggcaagggcacgggcaattgcgacacgttgctgcataccaccggaaagctgtgccggacgtttttttgccgcatgttcgaggccaaccatttttaaataatgagaggcaatgttggctttcttttctttgctgtagttttttgtctcgagtcccagttctacattcttttgtaccgttctccatggaagcagtccataattttgaaaaatggtgacatatttcatggaaggtttctgaacaatctgattttcgattttgatttcgccggatgtcggttttaaaaatcctgccattgcatttaaaagagtagattttccacagccggatggtccaagcaggcaaataaattcccctttttcaatatttaaagaaacatcatctaaaatgacatgagtttgattttcttcttcaaaagaaattgttacatttgatacatctatcattttttacgctccaaatccgaattttgtacgaatcagtttctcagctatccgaagaaatccatctaagataaaaccgatgacaccgatagttaacatagttgcaagtaaagagtcaaaccgcatgcagttttttgtatccataatcaggaaaccaagtccggactgagaaccaaccatttcaccggatacaaggaaaatccaggaagttccaagtgccagacgaagtgcgttggaaatctgggtaaaaatggcaggaaagataatacaaaataatgtttttactttatttacaccaaagctgtctgcgattttataatagattttatcgacattttgaactgcactgacaacagagagcagaattgggaaaaatccggcgataaagatgattacaattgcaggtacatcaccgattccaaaccagaatacgataaatggcatgaaagcaacgggtgcaatcgggcggataatctgaagaatcggattaataaaggtaaatacacgcggaaaacttccaagtaacagtccaagcagaattgccgaaacagcagatgaaaaataaccgatggcaaaacgaataagactggtttcaatatgaagaggaagtataacagaagaagtacttcccggcagtccggtcgtacaaagctgaatgaatgcctgtaatactttatatggagacggaaacagggtttcattggtgtgggcgagggtgcaggctgtctgccagagcaccactacaaccacaaaagaaagaatcgttcgtattgtcttttttaacataatcttttgtcctcacaatctggatactgatttactggtaaatgaaatcattgtaggacggtggattatcgttgattccgtattcttttactttttcacttaattgttcataatcatcaagtgagatgtcaaggtcatcgtaatgaatccattctaatgagacatcaagagttttttcgtcctgtcctaagtatttttcagctacttcttttgcgattccttcgtccaataaacttccggcttctttgtatgtagaaagaaattcgtctgcggcctctttattcttatcaaggaatccgccgttaaatacgagtgcacagcagatagaatcctgccataaatcagtggaatcatataatacgtgaccgtaaccctgtacaatagcctgtgcgccaaatggttctgcaacacagtatccatcaatggaaccgcttgcaagggaagaaggcatttcagatggagcaagctgtaccacattgatatcatcaatacttaagtcgccaagtgcaagcatgtcatttaataagatattgtgtgaggactgattagaaggaattgcaaaagtttttccttttaaatcacggacatctgaaatatcatcagatacgatgacaacatttccgtctttatgaccaagagcagcagcctttaagtcaattccgttacttacggctcccattgcaagttcaacgagaacagaagcaccatcgatttttccggagttcagtgcatccattaaatccgtccaggaactgaatttttgaagagtgacttcaatatcgctgtctgattttttatctaaaagttcttttgtctcaaacacagccagtgcatgtgtgattggcagatagcctaaggtaatattggtttttgaagagtctgtttttgtagtgtcagcggctgaggtagagtctggatttgtggtaccgcagccggtcagagcactaaaagaaagtgtagcggctaaagcaaatgtaagtaagcgtttgaatttcatggttatactcctttaattatagttaaattcctaattgttttcgtttttctttcatatctgcgacaattttttcgccaagtgcaacagggtcggcatcgacaatcattgcagaatgaagtgtttttttcgttccttcttttaagaactcaatgactttagaagaaccgtgaattggagcttctacacaatggtaggagctgattccgtttaagcggaagccaagagcggcatcgattcctttttcattggaccattccggtgaggaaaaagcaaatggcatttcgtagagtgctttgttaaattcaccggcaattcctccgaaaataccagaagaacgggtattgtcaatacattctccaacatgccatacgggaggcatatccggatttaaaaattctcttaaaccatccccgcatttactgtaggcaaattcagaagtctgacagtatcccattttcataagagggaaggaagcacatccgtttgtgataataagtacgttattttttaacagtacatcacagacatctaagattgctttttcataaaggacttttggattgttacatccaaccatattgactactccgagaatcttgccggagcggatggcgtcggcaatcggtttgaaactgccgtattttttacagatgtattcaacagaaaatccgacttctgcttccacttcgtgttttggaataaagaccggaatgccttttcttgcttcaaaactttcgatggcacgcatgacaatccgttttgcaattgctttggtttcggcaacattggagtgatggtggtcatatccgatgtgttctgcacctggaaggcgggcagaatcatgagtagtaacaaccgttgttttaaaacagcgtgctacatccatgatagccggataaacttcctgtacgtcggcaacccagaggtcaagcgcacctgttccaagtaccagttctgcgctgacggcattagaaagaggaatgactccttcatagcggtacattgcggagagaccggaacagcagattccataaaactggataccttttgctcctttttcttttgcaaggtttaagagttcttcactttgtccggcttttacaatttcttttaccagaaccggaagatgtccgtgaactgcaatgttgacatagccttttttgagggcaccgatatttactttggaagtgacacggtcaccgaccccgagcagggcatctgttgcaatggaagtggaaacgaccccgctaaaagtaaaagcgagtccacagcgcaaaaactgtttcataacactttcccagtcgccatctgtcgcacatccggttttatgataagcttcaaaaacttcgtggtaagcactgattggaagaatatcaaggtctttccatactttctggcgttctggagttgcacaggcagaaatgactttgtattcatccggctcggttctggataaatcatcaagcagagtatctgcaaggtcaattgcaatgttttttaacgtacgttttttagttttgattccgaaggcttctgccatggagcgtactttgtattctccgatgattggaaggtcaagtttgccctgggcagcccattttaacattaagagcaattctctggcgtgcatcccgtgttgggcagcaccggcagcagcaccacgcagaagatttcttgcgacaattaagtcggcatctgcaccacagactccgcgaggagacttcggggtgattttacaaggacccatgttacagatacgacagcaggttccgcttaaaccaaaggtacattgtggctgttgtttatcaaaacggtcaaatgcagtgtcatatccaagctgttccattcgaagcatcatttcttttacagcagggtctggaacattatcaagcacatcctgtttggttggaaaggttttgcggtaagcagaaaccgctttcctgtagtcctcggtaaagacttcttcatggctgtgttcatattcgttgccgttttcatcaatatgtttatgagtatgaccgctgaccggtactaaaacctttgggattccgtttttatcaaagccgataatggctctgtgattatgtggttcaataacggtgttaaatgtttcatcagttgtatttttattttccataaattaattctccactaaattacttggtttttggttaacgagatagtaccactaaaaacatagtttgtcaataggtttagggggataaagtgaaaagttgtgaaaaaaatgtgaaataaaaataagaaacttgacagaaaaaaacactggtgttatattacaaatagaacaaaaaacggaaggaggaggaaacaatggctgtaaaacgagattattatgaagtgttgggagtgtcgaaaaatgcagatgaaaatgcgattaagaaggcataccgaaaacttgcgaagaaatatcatccggatacaaattcaggcgatgcggatgctgaaaaaaaatttaaagaagttacagaggcatattctgttttaagtgataaagaaaaaagaaaattatatgaccagtttggtcatgctgcgtttgatgagggagccggcggcggaacttatcagtcgcaaaatcaaaatggaggatatcaaagagcgtaccattttaattccgatgatatgggggatatctttggggatattttcggggatatgttccatggaggacagagaagtggaagaagaagcaagagcagcttctatcaaggcggttttggaaatggctttggaggcggttttggagcggatttcgcacaaaaaggtgaggatttgaatgcagaagtgaccgttacatttgatgaagcggcatttggctgtgataagagaatccgcctgtctttacaaaatggtcagacacagactttggaggtgcatattccggcaggaattgaaaccggaaagagtatccgtttaagaggaaaaggacacccgggaagcggaggcgctgaggcaggagatttactgttaaaagtaacggtcatggaaaaatccggctatgaacgaaaaggaatggatgtctatacaaaagttcaggttccgtttacaaccgcagtatttggcggagaggctatggtaaagaccctttatggaaatgtcatctgtaagattcgtccaggaacacaatccggaacgaaaatccgtttaagaggaaaaggaattgtatcgatgaaagatgcttcggtacatggagaccagtatgcagaagtagaaatcttggttccaacggatttaagtgtagaagcacggcagaaattaaaagaatttgaagcactatgcaaaaaaaaacaagataatcggtcagtagcataaggaaaaccgcagtatcaagagaaaatgatactgcggtttttgcatgtttaaacactttgtaaaagttagtttctttgataaatccgaactaattttttgattttattttgtaaatccgaagtaaattctccatctaagagacgccatttccagttggttcctaaagtagatggagtattgattcggcaggtgttgttaagtcccagataatcctgcattggaatcatacagatacgtgcagggcttcccataacacggcagataactgaccagtgcagactgcggtcagaagttgtataatcatgaatataatcgcgtaacatttctctgctctcttttgggatgtcctgataccatccgattaaagtcgcattatcatgagttccggtatagacaacagagttgaccggataattatgtggcaggtaatcacctgcacatccggtatctctggaatcaaaggcaaattcaaaaactttcatgcctggaaatccgctttcaaaaaccatctggcggacactatccgttacataacctaagtcttctgcgatgacgtcacgttcaccgagaacttctttcatacggtggaataattcaattccgggacctttttcccaatgaccgtttcttgcagtggtatctccataagggatagagaaatattcatcaaagccacggaaatggtcgattctgactacatcatagagataaaatgcgtaagaaagacgctgcatccaccatgtataaccggtccggcggtgataatcccagcgataaagcggatttccccatagctgtccgtcagcggcaaacccgtccggagggcatccggcaaccgcaagaggaacattttcttcatctaactgaaagagttccggatgagcccaggtatctgcactgtcataagcaacgtaaatcgggatatcaccgatgatgcggataccgttttcatttgcataagtttttaattttttccattgaatggaaaattcaaattgcatgtatttctggaattcaatttcaaaataaagctgttcgcggtaataatcaagggcatatccgtaacgttttttgatatcctccggccacttatcccaacattcgtcttgaaagaatccttttacagccataaataaggcgtaatcgtcgagccaccatgcattttcttcctggaatgtccgaaattctggattttgggaaatattgcttctttcataagcttttcgaagcagtttgtagcgggctttataaagttttccgtaatcaataaaacgagaatccaaaccaaaatcagcaagatcacattcttttttagtcagaacgccttcttcgattaaggtatttaaatcgataaaataaggatttccggcataagtggaaaaagactgatacggggaatctccgtaactggttggtccaagtggaagaatctgccagtatttttgattggccaaagccagctggtctacaaattcataagcttcttttgaaaaacagccgatgccgtattgggacggcaggctggatatcggtaataaaataccactttctctcataatataaaaactcctttcttttgtcgcaaaaagcttcttcctggttagagctatgtgtgaataaagatattctaacacagggagaagcatttttaataaaaattaaagttctaaaattaaagcctgatatccatgaagtgttactttgtttccgtttaatacaacatcattatagttgtttaagagaacggatttatatggagctggaagagcaatggtctgttcttgtgtctgatagtttccgataacaagaagcgtcttgtctccttttctgtaataagccatcaggttatgtgtatcttcaagatacggaatgacatcaccataaacgattgtttcctgataagcaggatcttttctaagtgcgattaatttcttataataagaaagaactgaatggtcatcatgtaactggctttctacattaatctgggtatagttcgggtttaccatcagccatggggtgcctgttgtaaatccggcatttgtgccggcattccactgaaccggagttcttgcattatcgcggttataaagggaaataatttttagggcttcttcttcggagtatccggcttctattgctacatggtactggtcaagtgcggaaacgtcatcaactttttcaaaaggaattacaccgagattttccataccaatttcctgtccttgatagatgaacggaagtccacgaagcatgaagtataatgtagccagcatttttttgctttggtcggaacactctccttccggaatataatagctgacaccacgtggttcatcatgattttcaataatgttagataaaaatccgatcgaaccgattcttttctgagagtggaaacaacattttttataatcatctggagtaatgcgggtatttgcataccagcctttatcactttttccaaaggaagtgccggcaaaatcaaacatggaagagaagtagccgttatctccgatgaaatccggaagctcttcgtctttttcattaaaaacttcaccgacggtaaatgcattatgaggattaaaggttttgtcacgcatttcgcctaaaaattcaccaacaccctttgcatcagcaagcatctggtcgatacagcttaaattatcatcgcggtctaccgtgtagtctttataaggaagtttctttttgatgttgatgatagcatcaatacggaaaccgccaagtcctttatctaaccaccagttgatgtttttgtaaacttcttcgcggacttttggattttcccagtttaaatccggctgttttttgtgaaatacatgcatgtactgcttgtcaggatgtcctggaagtggttcccagaccggacctccaaaataacttctccagttacatggaagttctccctctttgcggtcttcaatatagaagaagtttccatattctccgtcagggtcttcacaggctttttcaaaccattcatgttcatcagaacagtgatttacaaccaggtccattaagatatacatgtcacgttttttggcttcttttaaaagatgatccatgtcatccattgtgccgaagcaagggtcaatttgatagtagttagagatatcatatccctggtctgcaaatggagaagagtaaattggagaaatccagacaatgtctactcctaattcttttaaataatctaattttaaggtgattcctggcaaatcaccgattccgtcgccgttggaatcataaaagctcttcggataaatctgataggcaactttattgtgccaccattttctttccatagcgtgtatcctcctgatttttttatcaattttcgtttcgctcattacttatgcggataagtaatagtataatgacaaaaaatgattttgtcctacgaatatctgatgaaaaactacgttattttgacttgtgcgtttgtgaaaaagattttcgatactgcagaggtgtcattccggttttttttcggaattcttttaaaaaatttccgagattatgaaatccgcagtcaagacagatgtccataaccggacgctgggtatcctgaagcagagtaatggcacgcccaatgcggtattcattgatataggcgacaggagttttgccgatatattttttaaaaaatcggcagaaatactgttcatttaagccggcattttgagcaagggtatgcacataaaatttttcaccataatgctgatgaatgtaagcaagtgaatttttaataatttcaacccgataatcatcatccgtatgctcttttacggatagaagctgatattgttctaaaaaggcaaggatttttaataaaccggcacgaataaacagctgggaggctaaatcgtttgtgaccatctgatactcgttgattggagcaaatccattttgataaaacgcatttacaatttcaagatattcttgttttaatctggaaaaaacaggatgttccggtttaatacagcgtggaaaatagagctctcccttcatcatgggctgtaaaattcggctctgtgcgatatcataactgtcaaaatttaagattctcggatgaaaaacgacagctgattcttttacagaagtttttgctaaaatagaatggagttcaccagaatttacaaaataaaaacattcatctgtgatggtgtaaatattcatattgatgactaattcaaattcgccttccataaaataaagaatttcaagttcatcgtgccagtggtgtttgacaccgttccagttcttatcatcataagtctcataaagaccacagggaaaagaaaaggttccgtggtctttttgttcttttaaagtcgggtttgtgtttgacggctcagtcttttgcatgatacattccacctttctgctttgtaaaacacaataatccacttaaagtgataaacattgtagcaaattccgcagcgggaaatgccagccagatcccggtcattttaaagcaggcagaaagcacaaaggcaaagaaaatagttgcaacaaatccacgtgaaatagaggcacaaaaagcatatttaacggattctacagcacttaaggccgcagttccgacgatgttaattccagcaaataaaaatccgataaagtataatcttaagccagagtctgcataagcagcaagctgcaaatcgtgttcactgttaaagacagcggtgacagcaggtgcagaaaagaaaataaaaatcatcagtaaaacaccaagaccaagtgcagtggtgagagccatttttaaaagggagcggacattttgttcttctcctcgtccataggatcgactgataagcggctgagatccttgtgcaattccattaaacagtgcaacagcgaccaaagaagtattggcgacgactccataagcagcaacaccggtatttccggcaagatttaagataatcatattaaaggtaactgtaataacgcccgaagaaatttctccaacaaaggcagaaactccaacttgacaggaataaatcagctttttgatggacggcaggacaggaatcaatttaatcgtggatttcctggaaaaaaagtgaatacagcagattaaaattccgacaaccggagaaaaaccggtagcaagagctgcccctttcatagcaagaccgagaggaaacattaaaatgtagtcaaagacaatgttaaataaactgctgaataacgtagcagccatggcgatggatggatttttatcatttcgcacaaaagcgttgcagatatggttccacataaaaaatggggaaaaacacataaaaatccgtgtataggaagttccggtctgaatgatttcggcatcgccgccaagcagtgcaactaatttatccggaagaaaaatcccaataaagacaaaaattaagctgataaaaaatgcacagattagtgcatggaaaaagtatccgtctgcatccggattcttctttccacgttcaatcacaaagcggatagcagagcccactccaatcattgccccaattgcaaaaatgagattataaagtgggagtaccaggtttagggcggtgataccatttgaaccgactgcttttgaaataaaatacgtgtctgcgagaatataaagcgacatgccgagcataccaagcatattctgggagacatatttggtgaattgttttaacatagttttgaaatacctttcatttagatataattctaatagatatggtagcaaaaagtggcggattttgccagactttctttttaaaaacgcttatgctataatggataatcataaagattggagcaaaggcatgagtaaaaagagaagaaaaaaggcagaatgggaggcattatccgtaatttggtcctgattatcgcagccgcagtctttttattttctgcttatcaactggtcatgatttatttggagtataaaaaaggtacggatgaatatgataaaatcagacagtatgcggtagaaagtcctgtaaaagaagagacaaaagaaaatgatgaagcagaaggggaagaagagggggaagaggctcaagaggttcaagaacctcaaggaccacagattgattttgaagcgttaaaggcagtaaatcccgatgtggttggctggattgaaattgaaacactggatatcagttatccgattgtacagacgacagacaatgaccattaccttcattatacttttgaaggacagcgaaatgcgaatggtgcgattttcttagagcatacaaacagcagcgattttgaggactgtaataccattatttatggtcataatatgagaaatggctcgatgtttggtacatttcgcaagcttcatgagcagtcaaatctgacgagtccttatgtctggatttgtacaccaaaacatacctggcgttataaaatcttttcggttcatactgcgtcagtaacgggagaaacgtatactttattcagcatggcagatgaacagtttgccgagtatttaaaatctatgaagtcagcgtcagaattacaattagatgccgaagcagacaaagacgataaagtgattactatgtcaacttgtacgggaaacagcagtactcgttttgttattcaggcaaagcgccttgagaaaggagaaaattaaaatggataaaaaaattgaagcattgcagaaattaatttcagggcatcaaaatattgtgttctttggaggagcgggtgtttcaacagaaagtggaattccggatttcagaagtgtggatggcttatatcatcagaaatgggattatccgccggagacgattttaagccatactttttttgtaagaaagcccaaagagttttatcgcttttataaagagaagatgttatgcgagggtgcaaagccaaatgcagcacataaaaaactggcacagttagagaaagccgggaaattaaaagcagttattacacagaatattgataatctgcaccagatggcaggcagtaaaaaagtgtatgaattgcatggaagtgtgtatcgtaattattgtacaaaatgcggggcattttatgatttctcctatatgaaacatgcagaagggattccggtctgtaaaaaatgtggtggaattattaagccggacgttgtgctctatgaagaaggattagataatgaagtcatagaaggtgcagtccaggcaatcagagaggcagaagtgctgattatcggaggaacttctcttgcggtttatccggcagcttcgttgattgactattttaaaggagatgcactggttgtgattaatcgagataagacgccgagagataagatggcagatttggtcatcaatgaaccgattggaacggtatttgaacagattcgtgtagaataaagggagataaagtgatttggaacagagagaacggtaacagagtaacagaagaaaggaagagaaatggcatatcagtacgaagttggtgatattgtaaagttaaaaaaacagcatccgtgtggaagtaacgaatgggaaattcttcgagtgggagccgattttcgtttaaaatgcatgggatgtggacatcatattatgcttgcaagaaaacttgtagaaaaaaatacgagagatttgaaaaaaaatacttgattattcagaaaaagcatggtagaattaatcctcgtgatatatgattatccttgctctccaaaaagagtggagggccaaaagaccaaaaggaggtaaaacaggcatgaacaaatatgaattagcgttagttgttaatgcgaaaatcgaagatgaagctcgtgcagcagttgtggaaaaagcaaaaggctacatcgcccgttacaacggaaatgtaacagaagttgaagaatggggaaagaaaagattagcttacgaaatccagaaaatgcgcgaaggatattactacttcatccagttcgaagcagacgctgactgcccagcagaaatcgagcgtcacgttcgcattatggacaatgtattaagatatttagttgtaagaaaagacgcttaattttttcttagagcacaaaatgcgaatccccttagaattatagtgttttataattcccgattctatgtgctgctacgtacaatgtaaaaaatgttgaggtgaaagatatgaacaaagtaattttaatgggacgtttaacaagagacccggaggtaagatactctgcgggagaaaactcactggcgattgccagatatacactggctgttgacagacgtttcaagagagacggagaagcaactgctgattttatcagctgtgttgtatttggaaaacaggcagaatttgcagaaaaatattttcgtcagggaatccgtatcgtagtgagcggaagaatccagacaggaagctacacaaatcgtgatggtgtaaaagtttacacgacagaagttgttgtagaagaacaggaatttgcagagagcaaagcagtaagcgacagccacgtaaaccgtagtgcaagccagccggcagcaccggatatggcagattcctcagcagaaggatttatgaacattcctgatgaaatcggtggagaattaccgttttaagaacggaatatagcaggaggtagaaaccatggctttcgaaaaagggaatagaccggactctccaatgaagagaagaggcggacgcagaagaaaaaaagtttgtgtattctgtggaaaagaaaataacgaaatcagctacaaagatgcaaataaattaaaaagatatgtctctgaaagaggaaaaattcttccaagaagaatcacaggaaactgtgcaaaacatcagagagctcttactgtagaaatcaagagagcaagacacatggctattatgccatacgtacaggattaatttgctgtatcgaagccgtcacaaagtactgtggcggcttatttttttactttagttcaagagaatttacaaggaaaaataggtacagcacttccaagaagggaaaaaatttagagttatgaagtataatatattaataactgaggatgaaagagaaattgccgaattaatcaaactgtatctggaaaatgaaaattatagggtattttgtgcggaagatggaaaagaggcgttagaattcttagagcaggaatcaatagatatggcaatactcgatattatgatgccggggatggatggatatgaactgacgaaacagattcgtaaaagaagtaatatgccaattctgattttgtctgcgaaaacacaaagttgtgataaaataagaggcttaaatcttggggcagatgattatatgacaaaaccatttgacccgcttgaagttgtagcaagggtaaattcggcattgagacgtttttatcatttaaatggtgagccggaatccaaaaatgagaatcatattttaaaagtaggagatttggtgttagatacccagactcttgcactgaaaaagagagacgaagaagtttttctgacaccaatggaatataaaattcttgcattgtttatgaaaaatccagggatgatttttaccaaagttcagatttatgaaaatacctgtggggaatatgtcgaaagtgatgataatacaattatggtgcatatctcaaatcttcgggaaaagatagaggagaatcccaaaaatccacagtatattaaaaccattcgaggagtaggatataaaattgaaaaccgataaacgaaaaaagggcagttttttatcacttattatccggaattatctttggttttcgtttgctgtgctgctggctttgatgtgtattgttgttgtgattaactggatgggagaacagcatttttcagggttaaaaaccaaaaaaattaaaaaatttacggaatatctggaagaggggaattatgaaaaatttccatctgatattttgctgggacaaaaaggagcatttgttattttggatgaaaattttcaaatgatttatcaaagtaaaagtgacatgccaaaaagatttacagaggaagaattgttttttgtcaatgagttgggtatgaaagaaaagataaaagcaattttttatcaagatgaaaatgaaaacgaacggattttaatccaaagggaaaaaacaaaagagggtactgaaaagaacaaaaaagaatatctgcttttggataattctggaacagtattggtcaatcagatggggtttacaggaaagaatgtgaatcaaaaagagttggattatattataaaaaaggggaaaaatccggttcagtatgcaaagtgggaatttaaaaacaagcggggaaagagctatacagcagtttttcgctatgaaaaaaaagatgcaaagaaatatcttgaatttacaaaatccatgcgagtggttcagtggttgattcttccactttatgctctgattgtagcagtttttgccgtgcgtttgaatcataaggtgaaacgtccgctgatggcactgaaagaatcaattgtatgctatcagaaaggtcagaaattaagtaatgacaacaatggaccggatgaatttgtagaaatcggggacgattttgtaaaattggcacaaaggctggctgagagtgaagaacgaagaaaaatttctgatgaagaaaaacagcagatgcttgcagacatttctcatgacttaaagactccgattacgattatccaaggctatgcaaaggcaatctgtgatggtgtcataaaagaagaaaataaacagcagtatctacagacaatttatcataagtcaattgttttaaatgaattgattaatgcattttcagaatacagtaatttggagcatccggatttcagaccggtgaaaacaaaggtggatatctgtgaatatgcaagagaatatttagcgacaaaatataatgaattggtgttgggcggatttttgatagaagtagagataccggagatgataatctggtgtcagattgatgtacaacagatgaagcgggtatttgaaaatctgattaataactctgtcaaacataataaaagagggacaatgcttttcttttcgatgaaaaaagaagcagatacgatttgtatcagtatcggagataacggtacaggaattccaaaagagctagctcaaatggtatttgaaccgtttgtggtgggagatgaatcaagaaatagccggcagggaacaggtcttgggcttgcgatagcaaagaaaatagtggaggcgcatgacggagtgattgaacttgtaaaatttcccaaagaagggctttcaacagaatttcgaatctggatgcatacggataaggaataagaagcggtattgtacaaaaataaaaaaaatgatataataagccagtacatgcttatccggatgaatcgaaaataccggaaaatgttaagaaatcggaaggtaagaggatatgaatggcaatatcaagataaagggacagcttaagctgtatatgcagtggccggttatcatggtacttttactcctgcttatggatttgtgtattttccgcatcagtataaagggcggagtgattgcaacctgttttatagcggtgtatcttgcgatagcagtttttcagtatcataatagtcgggctgatatactcaatgagctgatttcttttgccacacagtatgggcaggtacagaaaagtctgttacgtgattttattgtaccttatgctttagtggatggcagaggaagaatcctgtggatgaatgaggcattttcacagttgagccagaaaccggtcaaataccacaggtcgattacaagcatttttcaggaaattacaattgaacgtctgccaaaggatgaatcttcagaggttctgtttcagtttgaaaacagagattacagagcttcgatgcgcaagatttcaattgaggcaatgttagaagattcaggtttgattgaatcggatgcagataattttctgacggcaatttatatttttgatgagacagatgtaaatcgttataaaaaagaacgcgatgaagagaaactggtaacaggacttttatatctggacaattatgaagaggcgttaaacagtgtggaagaagtccggcgttcgctcttagttgcgttgatagagagaaaattaaataaatatttctccgagatggatggtctggtgaaaaagttagaaaaagataagtttattctgattttatgccagcgttcgttagaagagttaaaagaaaaacggtttagcattctggaagaggtaaaaagcattaatatcggtaatgatatggatgtcacaatcagtattggaattggaattaatggggcaaattatgtccagaattatgagtattcgagaattgcaattgatttggcgcttggacgaggtggagaccaggttgtcataaaagaccgtgatactatgatttactttggtggaaagtcacagcagatgggcaagacaacacgagttaaagcgagagtcaaagcacatgccttaaaagagtttatggtagcgaaagataaagttgtggttatggggcacaagatttctgatgtggattcaatcggtgcgggaattggaatttaccgtgcagcgaaatctttgaataaacgggctcatatcgtagttaataatccaaccatgtcggtgcgtccgattattgaaaactttattaataatccggaatacgatgagcacatgtttgtaaacagtgcagaggcaaaagaaatcgtagataataatacggtagtcgtagtcgtagatacgaataaaccgagttatacggaatgtgaagacttattgtcaaagacaaaaacgatagtggtattagaccatcaccgtcagggtgcagaagttatttccaatgctgtactgtcttatattgagccgtttgcttcgtctgcctgcgagatggttgcagagattctgcaatatttttcagatggaattcgaatttataatatcgaagcggatgccctttatgcaggaattgtaattgatacggataacttcacttcaaaaacgggagtccgtacttttgaagcagctgcatttttacggcgctgtggcgcagatgtaacccgtgtaagaaaaatgttccgtgatgatgtcagctcttatcgggcaaaggcagagacagttcggacagtggaaacttacagggattcgtttgcaattggaatctgcccaagcagtggactggatagtccgactatcgtagcagcacaggctgcaaacgaactgttagatattgatagtataaaagcatcatttgtattgacggattataacaatttgatttatattagtgcaagggcaattgatgaggtaaatgttcagctgattatggaacggctgggaggtggcggtcatattaacgtggctggtgcacagttgaaagatgcaacggtaaatggagcaattattcaattgaaagatacaattgaccagatgattaaggaaggagcaatttaagatgaaagtaattttaattgaagatgtaaaatctcttggaaaaaaaggaacaattgtaaatgtaagtgatggatatgcaagaaatatgctgtttccaaaaaaacttggattagaggcaaccccaaagaatattaatgatttaaaacttcagaaagcacacgaagaaaaagtggcaaaagaagtattcgaagaagcaaaagcgtttaaagaagaattagagacaaaagaaatcacagttggattaaaagtaggagaaaacggacgtacctttggatctgtttccacaaaagagcttgcagaagcagtgaaatcacagttgggatacgacattgataagaagaaaatgcagctttcttctcagattaaagagttgggtgtagtaagagtaccgattcgtctgcatccaaaagtaacagcagaattaaaagtcaacatcaaagaaatgaaataagatacgcttagaaaggagccatgactggcatggacgaagcactcataaagagaatacttcctcataatacagaggcagaacagtcggtaatcggctccatgattatgaataaagatgcgattgtgacagcatctgaaattattacaggcgaagatttttatcaacagcagtatggaattgtatttgatacgatggtggaacttttcaatgaggggaaaccggttgatttgattactcttcaggatcgtttgatggaaaaagatctgccgccggaagtatcaagtatggaatttgtcgcagaattaatgagttctttgcctacatctgtcaatgcaaagacctatgcggagattgtaaaagaaaaatcgatgctccgtaagatgataaagacgatggaggaaatcacaaatacctgttatctgggaaaagaacgggtgcaggatattatggaggataccgaaaagaagatttttgatttggttcaaagaaagagcaatgaggaatttgttccgattcgacaggttgtcttaaatgcgattgaaaaaatagaaaagtcttcgagaacaaaaggcagtgtaacgggaattccgacaggatttgttgatttggattaccagatgtccggttttcagccgtccgatttgattttagtggcggcacgtccatctatgggtaaaactgcgtttgtattaaatattgcccagtatatggcatttcggaaggatgtcacggttgcaattttcagtttggaaatgtcaaaggaacagttggttaaccgtctgctgtctcttgagtcaaaagtagattctcagaatatccgtacaggtaatcttgaggatgaagaatgggcaaaactgattgaaggtgcaaatattattggttcttccaatatgattatagatgatactcccggtatctcaatatcagaactgcgttcaaagtgcagaaaatataagctggaacataatcttggaattatctttattgactatttacagttaatgacgggcagtggaaagagaagtgaatcaagacaacaggaaatttccgatatttcccgttcattaaaagcattagcgagggagctgaatgtgccggtagttgcactgtctcagcttagccgtgccgtggaacagcgtccagaccatcgaccaatgctctcggatttgcgagaatccggagcgattgagcaggatgccgatgttgttatgtttatttatcgtgatgattattacaataaagattcagagaataaaaacatagcagaaatcattatcgcaaaacagagaaatggtccgattggaacgattaatctggtatggctgccgaactatacaaagtttgtaaatatgaaaaaataaaatgatgtaagtgtcaaaagtataaattgcggttgtgcttgcacaaagagcaatttatacttaattgacacgccgagcaccgaaaacgaaataaaatggtgtgaatacgccattttacgagagtttgaggtgttcgaggattgcgagaattgcatagcaatggagcaatccggttacatcagtgagtgacaaaatttacttttgacactcacatcataggataaaaaactgcggagcttttttagttccgcagtttttttgcaagcatttcaggattggacgcatgattgagtgcttcctgacggtcgatgactccttgttggtaaagtcgtaataaactgttatccatcgataacattccgttcgcagaagaagaatagattaagccgtcaatctgatgaactttattatctcgtatcatatttttaattgccggagtggtattcataatctcaaaagctggtgttaaacctccggtcagatctggaacaagctgttgggagacaactgcctgaagcacagaagaaagctgaacggcaatctgtctttgctggcttggcggaaatacatcaatgattcggtcaatagtatttgcagcacctaacgtatgaagggtagaaaagaccagatgtccggtttcggcagccgtcatggcaacagccattgtctcgtgatctcgcatttctccaagcagaataacgtctgggctctgtctgagagaagcacgcagggcagtgatataattttctgtatccgtacaaatttcacgctgacttacgatgcttttcttatggctgtgaagaaattcaagagggtcttcaagagtaataatatgcttttccattgtgctgttaattgcatcaatgatacaggcaagcgtggtggattttccacttcctgcaggacctgtgacaagaaccagccctttgttatgagttccaagatcaatgatttccggtgggattccaaggtcagacggatttggaaggtggaaggtgataacccggatgacggctgccatggaacttctctgcatataggtgttgacacgaaagcgggaaagaccggagactgcaaaggaaaaatcatcatctccggtttttaaaaaatgggaaatatcacggtttccggcaaggctataaatctcacgaatcaatatttcagtattttccggcatgatacgttcagaagtcaattccattaactgaccgctttttttataagaaagaggaagtcctgctacaatgaaaaggtcagaagctccaagttctgttgtcttttttaaaaaagtaagtgcatccatgtttatattcctttcttggattagttatctccggtgtagacaggcagggtatcatcggcttcccatgtctgtgcgttgatcagtttccaggtctctatctgatagaaagagtccccttttttgatttcagaatttaaaagaagcaccacctgcagaatttgatgttcatttactttgatttcataagcaatctggtctttggatggaaaggagattccatcaaggctggttaaattctgctgtacctgtttaagatagtcggaagaatcggaggattgataggtggatttaagaatagaatcaattttatccattaattcgttcgctgaattttcagcttcatagacttcatgagtatgagcgctgttttttttcaccagcttatagtctgcatttgcactgacaagggaaagcactgcgaaagtcagcagacataaaataacgaagatcaataagatagaagaaattccaattccaataggaagctgatgtttgtctttcattaagagttctcctttttttcatctgcggtgcggggaatggcagtttttaaatcaagtgtatcgatagaagctccgtctgcatcttttaatacaatagaataatggttcaaatgaccgtttgtctcttttataatagtcagatagtaagtggcattattagaagaaacagcagttccattttcatcataagcaatctgccatccgtctttggtttctttcgctttcggaaataattcttcaaaaggagtatttgtattagaagtatccatataggagagtgcttctgcgacagaagagacaagagtagaaccaagagactcttcttttgcttctttgctggttaagtgtgcttttacaaatacctgaacgcagagcatactggtaagagaaaaaaagaaaataacaaaaatcagctcgagtaaaaaaaggctggactgtgaagcgtttcttttattcatgatgctcctccttttgtgtcggtcgaatgactgcggatatgaataagaagagaggcggaagtattttcttcgtccgttacggtaaagcgcagtaaattttcgcccgcttgttcaatggaaaaattttgtatggctaaaatcttttctccttgtgatttttttacaggttgtgaggcttgtacaaacagctcttttaaggcattttcatcttcataaatataagtaatgtaagaaacgccgccaatggattcagaaagttcaagggcaggagcatcttcaagagttccaagggagattgaagatgtcgaatcatgttggcggactttttcagcaacataggtaagagccgtacgagtcgtatagtttgttttcatatcaagtgctgtctgtttataaacatgtgctccgattaagagaacggtcaaagaagagatggtaaacagacatagaagcccaagggagaaaagcaggtctgtaatatgcacttgttcatggaagcgcctttttttacttattttacgcatggcagttcccccttgtttgtcagaataatgacatcaatatccggcatcaggttagaagcatgaacctcatagcttataagatattttgaatgatcataagtgattccataatggttctccagataagaaagactttccggataagctccttccacggcataacagtaaatggtactgcggataacagcctgttttaagttctctatttcttcttgttttgtagtagctgagatagaagagacaggaagaagaaacagaaaaaaaacggcaaaaaagacaacaactggaacaagaatcgaaaggacactttttgaaattggtttttgctgtgtaaaacgattcataataaaaactccttttggataataggtgctttcagccacaaaagcaaggataataaaaattccgagcgtacatgaatcagcccattccggacataattcccataagaggaagcataacagataaaagaatcaatcctacaataatcgaaaggacggcaacgagagttggttctaatttgctgattaattgaaagatgcgttcatttatatcttccgaatattggagggaaatctgtttcatgaccatgtctactgcacctgttttacaaccgatagaaatcatgcgggttgaaagcgaatcgaaaatctgactttcggaaactgcttcggaaaaaccttgtccctcttcaagcagggcacgtgttttggctattttttcttctaataccggatggtcggcaagacgggcagccatttcaagactttcatcggtatccagaccgctttcaagtgccagatacattccacttgcaaatcgggaaacagcaattttttcagagaatttttgagtaaacggcagtttggagctaaatctgaaaaattggttccggcctttttctgtaaatgtaaaatacaggaaacatcccgcaagtacgcctgcaagaaggacaagaacaaaggcataacggttcatcaggattcccaggtttaaaatatttttggaaacaccggttaagcctgttccaagctgttcataaacctggttgaagacaggcataactttgacaatcaaaacaagaataactgcaagcatcatggtaatcataataaatggataagtaatggcatttttgatactgcgggagatggtttcctgctgttcataatgttcagagagtgcagacataacttcatcgagtcgtccgctctcttctccgatttgtatcatattgcacatatattccggaaacactttggtatctcgaattgactgatgaaaaataccggtttcttccatattggaaatcagtgattctaataattcttttccctgttcggggctgtcctctgccatcagggaaagtccttcggtagaagaaatgccggaatgaagaatcattgacatctgcccacagaacatagaaagttcattgttggataaaggcttcataattaatatggctcctttcgtaaagtaaaataggataaggatagcagagtaagattaacgagtatatcgtgtcacataattgtctccatcgccaatatagtttaaaatttttttactgttagcatttgcagaggcaaaggttggatccattcgttcccagtgtttgccgtcaaattggatgatatcgtcaatccatcctgtttcctcaagatagacactaatccaggcatgataaactttgcctgcatagccaatttgaagctttgttgggattccctgagagcgaagcattgaggtcattaatgcggcgtaatcaaaacaaattcctttttgggtttccagagttttatcgacatccggcagatatccgttttggaccgtttctgctttttttgtatcataagtgatgttgttgatcacataatgatagatagaagaaaccgcatcgagatctgaagtggcattttttacgatatcagaagctttggatacaatcttgctttctttggaaaaattcacatactggtttggataaagataaggaacataatcattttccagagtgacttcaatgttttcagtataaagagaagcatactgtgttccggaaatattttcataagtcttgacggtataggtgccgttaccgcttgtaatcggcagggttacatatccatcttccggttttatgaaatatttatattcaatttcatccggtccaattaactggatatttgctttttcggatgttcccgaatagtaagccatcacatagccctggtccaaatgggatatgtcaattaacaaaggctcttgtccgattacagaggtaccggaggcttttggaatatgtaaatccggtttatttggacggacagtttttgaggaagaagaattttcctttgttgtaccagaagaagatttgccggaagagcaagcagtcagaggaaataaaacccataagagattaaaaaaaagaagaaagaataaaaccttatggtatttataaaacataagaaaaactccttaatctgaggtaaaatctgaggttaaaatcttgtaattatcatagcattttttaaagataagtgcaatgataagcaaaagtaaccaaaaactgtaaaaagttattaaaaaacttgaaggattagatattgtattctctcaaaaaattcgataaaataatggatatgcatacggggaccttatagcggaagctgtaaaggagtgatgcaatgaaaaaaataataaaattaaaaaataaatatggtatgattgtgtgtgtgttgttttgtgtgatttatttttgtcttggatgcggacaggaagatgagacggtatttttggagcaaaaagaggaactttcagaagagacagaaaaaacgaacgagacggaagtggaaaaggaatcaaagccaaaagagtcagaagaatctgaaacagaagaccgggaaaccaaaagtgccggtcaggaacagatttgtgtttttgtctgtggatttgtaagaaatccaggggtctattatttgaatataaatgccagactttatgaagcggtagaagcagcaggaggttttttggaagaagccgatgccggatggcttaatcaggctgagattttgtcagatggagataaggttcggatttattcaaaagaggaaacacaaaaaatgcaggaagccggaatgaaagaggaaagcgggacagcagagaaaagtgtggaaacgaatcagcaaaatcagacacaagatgcaggaaaggtaaatatcaatactgcatctgcagaggaacttcagacgatacccggaattggagcggcaaaggcagctgcgatcattgaatacagggaagtgcagggggagtttaaaagcacagaagagatacagaatgtaccaggaatcaaggggaaaacctttgaaaaaatacagccttatctaacggcaggatgaaaaaaaagcaaggagagaatcgatgagtaaaaaagtattggtagtagatgatgaaaaactgattgtaaaagggatccgtttcagtctggaacaggaaggaatggaagtagattgtgcttatgatggagaagaagcgttaaataaagcaaaagaaaatcagtatgatatgattctccttgatatcatgctccctaaaatgaccggtcttgaagtgtgtcagcagattcgggaattttcttctgttccgattattatgctgaccgcaaagggagaggatatggacaagattttaggtcttgaatatggagcagatgactatattaccaaaccatttaatatccttgaggtaaaagcacgtatcaaagcaatcatgcgaagaacgcagaaagaaaaaaaacaagaagaacgctcgaatacattagaggcaggtgacatgcgtttagactgcgaaggtcgtagaatttttattgccggaaaagaaattaatctgactgcaaaagagtttgatgtgttagaattgcttgtaaaaaatccaaacaaagtttacagtagagaaaatctgttaaatcttgtatggggatatgaatatccgggagatgtgcgcacagtggatgtacatattcggagacttcgtgaaaaaattgaaacaactccaagtaatcctaaatatgtgcatacaaaatggggagtcggctattattttcaactgacaaaataaattttgacgagggcataagacgtgaaggaaaaaataaaatttactttttttaagagtttaagattccggattatggtgattttagtggtaatcggaattgtcccaagttttattgtaaaaaatgtagttgtaaatagttacgagacaagagcagtttccatacgggaagtcaatctcaaaaatcagtgtgatattctgggaaatcagctgatgaaagaaaattatttaagagagccggattccgatgtgatcaatggagaactttcgatgttgtcggcaatctataatggtcggattcttattattaataaggatgcaaaaattattaaagatacctatgatattgatgtcggaaaatacgcactttcagaagaagtcattcaatgttttgaagggaagagtacggcaaattatgatgataaaaatgcttatatagagatgacaagtccaatcaccaagatggattccaatacaatcgaaggtgtaatgctagtcagtatctctaccagtgaaattgaggacagtatcgatatgctggaaaacaggggaaatcttctgcttagtattatctgtattttggtactggtttttggatacctgttggcaggagttttagtaaaaccgttctcaagagttacaaaagcaatcgaagatttgacagacggttatctggatgaagaaatttctgttccggattatacggagaccgagctgattacaaatgcatttaataagatgcttggccggatgaaaacacttgatgaatcccgtcaggagtttgtatccaatgtgtctcatgagttaaagacaccgatgacttctataaaagtacttgcggattctttagtgggacaggagaatgtaccggtagagttgtatcaggagtttatgcaggatatcacagtagaaatcgatcgtgaaaacaagattattacggatttattatctttggttaaactggataaaaaagcagcagacttaaatattgccgaagttgatattaatgaaatgcttgaaaatattttaaaacggttaaatccaattgcttctgtcaagcatgtggaacttgtgttagaaagttttcgtccggttgtggcagaaatcgatgaagtgaaattaagtctggcattttctaatttaattgaaaatggaatcaaatacaatgtagaaaatggatatgtgcatgtcaaacttgacgcagaccataaatatttctttgtaactgtaacagattcgggaatcggtattccggatgaaagcattgacaagatttttgaacgtttttatcgagtcgataaatcacattccagagaaatcggcggaacgggtcttgggcttgccattacaagaagtgcaattgtaatgcatagaggtgcaattaaagtaaaaagtgaagaacataaaggaacaacgttttcggtaagaattccgttgacgtatatcgcgtaaggaggcagaagcatgaaaaaaatgcggatggcaggactcttttttctgatagtctgtatgttgactgcttgtggcacaaagaaaacggaagaaaaaacagagtacaaaatgtattatctttccgcagcagaaacttctcttgaagaggaaatctatacaccgacaaagacagaaacaaaagacattgtagaggaaatctgtgaaaaactgaccgagacgaatccagataatgatcatcttcgtctgcttcccaaaaaagtggaaattcttgactgtgagtataagaatggaacagtctgcatcgacttcaataaagaatataagaaaatgaaaaacaccagagaaattctggtgcgggcaggaattgtgaaagtttttactcaattacaggcggtttctggggttacgtttgaagtagaaggagaaccacttttagattccaatggagaagaagtgggaactttggggaaggattcctttattgaaaatgagggaagaaatattaatacctatctatatacagaacagacgttatactttgccaataaagatggagataaactggtgaaacagcaggtaagccggcattacagcagtaatgttccgcttgaaaaagcaattgtggaatggctgattaaaggtccgacaaattctgatgcgcaggcaacgatttctccgtctactaaaattttgggtgtttcaattgtagaaggagtctgctatgtcaatttggataaaacatttttaagtgacccgatgaatatacaggaaaaacttccaatttattcgattgtcaattctttgatggatgcctgtaaaattcatggggtgcagatatcggtagaaggtgagacaaaagtaacatttcgggaaagtatgaatctggataaactatataaagcagattatagtttagtagaagatgaggagaccattgatgagtaggagaccgttgtgcatcataggatgtctggtcatactgattttatggagtttaaatctgatgggagtttccacttttggtggaacttctttggatttaaccgattctgaccgttcagtaatcatacaaggcatcctatataaacaggaatcaaattctttttatacaagtctatatttaaaaaaaacaaatctgattcaaaattcaaaaaaacaatccattgataatgtaaaagcaacaatcaaaacagaatatttaaaacaacttccttcagatggtgacagacttttaatacaggggagattaaagcagatccaagaaccgggaaatccggggcagtttaatgaacgaagctattattatgcacgaaaaataaaatggtatctggaggcagaacaggtaacaattcaaaaaacagaggcagataagggtgtcacattcagaagtcggttaaaagagttattaaaaacaaaaattaagcagattaccacaaaaaagacaagtggtcttttcatggcgatattgcttggagaaaagtcagaagtagagagagaaacgttattgcggatgcagttaagtgctatgtcacactgtgttgtggtatcaggaactcatctttcaattttaggctggggtttgtttcgtttgcttagaaaattaagaattccgctttggatggcaggaatgatcagtatttttctgatgatacagtatggaattttcacaggaaacggggcgtcagccgtacgtgccgtgattatgttttctatggctgtgggagctgtgcttgtgggaagaacgtatgacctgctttctgcgctggcactttctatcttactgcttttatcagataatcccaaatggctgacagacagtggttttttactttcatttggtgcagtcattggtctaagtattttttatccgaaattaaaaagtaagaaagaaaacaaacttggaaatacatttttgggaagcatagctgttctgcttgtcaccctgcccattcaaatgtatgcgttttatgaaattccgctttttggaattttggtaaatctttttgttctgcctacaattggaatcgttttgataagtggaatggcaggttgtgtagctgcatttttttctctttttcttgggaaaattctggcttttcctgcaattcttattttaaatttttatttaaaaatcgggaaagtgatacaaagtattccacaggcgacgtatattacaggaagcgtttctcttaaaagagcagtagtttattatggaatactggcaggttggtgctttttaagaaagaaaagtaaaaaagttccaagggttggtctgattctggcagttttggttttactgtttccgactccccgaaatcagacaaagattacatttttagatgtgggacagggagactgtgcagtgattcagcaaaagaaagaagtctatctgatagatggaggaagcagtgatgtatcaaaagtgggaacctatcggattttgccatttttaaaatatagtggaatccgaacagtagatggaatttttttatcgcatccagataatgaccatatcaatggaattgaggaactgtttgaggcagttgccaaaaaagagaccagtctaaagatagaaacggtttatctttcaaaaaataaagaaaaagaagagaaaatcaatgaaatcgcacaacttgcaaagcgtgcaggctgtgaggtgcgttacataaaaaagggggcacagttaaaacaaaaggcatttcaggtagaatgtctttctcctgagaatgagacgggagaaagcaatgaaaattcccaggttctgctttttaaaacagataatttaagtgtgctatttaccggagatatggaacaaaagggagaagatgcagtgacagaacagttaaatgaaaggcaggaacagattgatattttaaaagtaccacatcatggctcaaaaaattcagcaaaggaggcatttttagaggctgcaggtgcaaagattggaatcatttcctgtggagaaggaaactcttatgggcatcctcacaaagaattgttggaacggctgaaggaaaagcagatagggtggtatgtgaccatagaaagaggagcgattaccgttacagcgggaaaaagaaataaactttctttctataaaaaatgaagtgtgatagaatagatgaaaagagcacacaagaaagaaatagaggaataatattattatgaagagtttgcaggaagacatcaggcagaaagagtttaaaaatgtctatcttttttatggagaagaagcgtatttaaaacaggtatataaaaaaagaatgaaagaggcattgcttcccgatggagatgaaatgaattttactttttttgagggaaaaaagacagaaccgcaggaagtgattcagatggcacagactatgcccttttttgcagaaagacgagtgatttttcttgagaataccggattttttaaaggtcagtgtgagagtcttcccgagtatctgtcacagcctcccgagtatctgtgtatgatatttatagaggaagaagtagataaacgaagccgaatgtataaggcagtaaaaaaatccggaaggattgtagagtttgcaaaacaggattcagatatgctgattcgctggatatttggaattttaaataaagaacagaaaaagattacaagaaacgatatggaactgtttttaacaaaaaccggcacggatatgggaaatattgaaaaagagctggaaaaactgctttgttatgtcttagaacgagatgtgattacaagagccgatattgaagctgtctgcacctcacaggtttcgaatcatattttcgatatgcttcgtgcggtgacagagaaaaaacaacagagggcactggatttgtattatgatttacttgccttaaaagaaccaccgatgcgtattttatatctgctggcaagacagttcaaccaaatgcttcaggtaaaggagcttgagaaagagggatatgaccagagtgcaatttcaaagcgtctgggaatccagccgtttgtcgtaaaaaattatcagaagattttaggacggtactccttagaacagttaaaatcagcagtggaaaaatgcaccaaaaccgaagagcaggtcaaaacaggatatttaaatgatgccttaagcgtggaactgcttttagttgaattcagcagttaaaatactcgccaagagggcttgacaaggtgcctgtgcaatgatatcatcttaatgatacgagatgtagatagaggttgcatttttcatgagtagatggttggatgttcaggagcagatgaaggcttttgaaagggaaagatgccgaaaaaatacaagacctgagcttgtgtttttgggcatgtcattaagagtggcatgactgtcatcgcaggatggagtgctatctgatagatatgaaacggatatctggagacggcgcatcttgccgtctcttttttagttaatcattcaaggaggaaaagatatggcaatttttaaaggcgcaggtgttgcaattgttacaccaatgaaagacaacttagaggtaaattatgataaactggatgagattttagaggaacagattgcaggaaaaacagattccatcgtaatttgtggaacaacaggagaatccgcaacactctccgaagaagaacacttagaagcaattcgttttactattgaacgtgtcaatcacagaattcctgttgttgcaggtactggttcaaattgtactcagactgcaattcagatgagtaaagaagcagaagaagcaggagcagacggagtgcttttagtaacaccttactataataaagcaactcagaatggtctgattgcacattatacagcaatcgcaaacgaaattaaaattccggcaattctttataatgtaccaagccgtacaggatgcgcacttcagccaaaaacaattgctcatctggtaaaaaatgtagaaaacattgtaggtgtcaaagaagcatccggagatatcagccatgtggcacaggttatgaatttgtgtgacggacagattgatttatattccggaaatgatgaccaggttgtaccgctgttatctttaggaggactgggagttatctctgtactttctaacgtagcaccacagtatgtacatgatatggtttacaaattctttgaaggggatgttgcaggaagccgtaaaatgcaattagaggcacttccggttatcaatgcgttattctgcgaagtaaacccgattccggtaaaagctgcaatgaatctgcagggaaaagaagttggaccgcttcgtgcaccgctgactgagatggaaccggagcaccaggaagtactcaaaaaagcaatgaaagagttaggaattttataaaataaacagaagaatccgctataagatacgaaaacaaacgttcttatagcggattttttgcatttttttagaggaaaatgacaggggaaactgtggattttaagaaatgtttagttgcctttttgttaattttatagtattataatttagaaatttaatgaattagcaaaaaatttaatgaattagaaataaaagaatagaaggtggttagaccttgataaaggaaaatcagaagcattttaaccggctgcatgtggtgattgatgcttttgtgattattatttcttattttttggcatggcttttaaagtttcatctgccgattttaagagatgagggcggacggcttccatttcatatctatatgagtgcgctgttatttattgtaccagcttatcttatgttgtattatgcatttagtttgtatacgccaaaacgagtacaaggaagaagacttgaattttcaaatatatttaaggcaaatacattaggattgtttctgttgattacagggttgtatctaattaagcagattgacttttcccgtcatgtaattgttattttttatgcaattaatgtcgtgtcagaagagttgactcgaatgctgattcgggttgtacttcgcaagatgcgcgcaaaaggttataatcagaaacatattttactggtgggctacagcagagcgtgtgaagaatatattgaccggattcttgcaaatcctcagtggggatatacgattcgtggaattttagatgataatgtacaggcagggtatatgtatcgtggaattaaagtgcttggacggattgataatctgatggtgattctcccgcagaatcatttggatgagattgcgattacactgggattgagcgaatattttcgattagaacagattgttgcgttgtgtgagaaatccggagtgcatacaaaatttataccagattataatcgaattataccgacaaaaccttataccgaagatattttaggtcttccggttattaatattcgttatgtacctcttaccaatacatttaatgcctttacaaaacgggtaatggatattgtaggagcgtgtgttgcaattatattattttcaccagtcatgctgttttcggtgattatgataaaactaacttctccgggacctttgatttataaacaggaaagagtcggacttcataaccatagttttctgatgtataaatttcgttccatggaagtacagcctccggaagaagagaaaaaagcatggaccgtaaaaaatgacccgagggttacaaatttcggtcggtttatgagaaagacaagcattgatgagctccctcagctttttaatgtgttaaaaggtgagatgagccttgtaggtccgcgtccggaacgtccattttttgtggataaatttcgggaagaaattccgcgttatatgattaagcatcaggtgcgtccgggattgaccggatgggcacaggtcaatggataccgtggaaatacttcgattcgcaaaagaattgagtatgatttatattatattgaaaactggacgttaggtctggatatcaagattttgatactcacattttttaaaggatttatcaataaaaatgcatactaaatacaataaggggaaataagatggcaaagagaagcagaaatactgtaaaacgcaaaagaagacgactaatatttggaattgaactggttgtactactggttttagtcggtgtgctttttgtatatgcgaatattacaaataaacttggcaaaattgatatttcagacagtgcaggcagtgcagatgtcaaagtcaatgagcaggtagtaggcagcaaagtcatgaaaggctatacgaatattgcgttgtttggagtggattcccgagatgaaaatctggatagttccaacagtgatacgacaattgtagcaagtatcaacaatgatacaaaagaagtaaaactggtttctatttatcgtgatacatacttaaatattggacaggataaagataaatatgacaaagcgaatgctgcttacgcaatcggtggaccggttcagtcaatgtctatgttgaacacaaacatggatttaaatattaaaaattatgtggcagttgactttaatgcgttagtgaaagttattgatttacttggcgggttggatgtggatctgtcttatgaagaaattgaacatatgaataactattgtgtagagacttctgaaaaaaccggggcaagttatgagccgattgaaaaaccggatccaaaaccggaagatgaatcaaaaattttaggaacttatcatttaaacggtgtacaggcaacttcttactgtcgaatccgttataccagtggatgggatatgaaacgtaccgaacgtcagagatatattatttctctgatggtggaaaaagcaaaaaaagcaagtctttctaccttaaatgatattatggatgaagtatttccgatgattaaaacgaacttctccaagaccgaattgattcagcttggaatgggtatcctttcttatcagttaggagatacacagggcttcccgaagagtaatatcatgggagaagatgtaaaagatgcaattggaattgattgtgttgttccaacgacccttgaagcaaacgtcaaacaattacatgcattcttatttgaccaggaggattacagcccttctgagactgttttaaaaagaagtgactatattgcagctcataccggatttggaaatgattatgtttcggatgaattaaaacagtatatttcagacagagaatctgcattggatgatgaggaaaattctgacagcgaagaagagatagatacacagtccgatgcaagcagtgagacttcagcagatgatatgtcagcttacagtcaggattcttcaagttcggataattatagtaatggcaattcaaatcataatgattatgattatgatgacagcgattatgattatgaagataacagtgacgactatagtggatatggcaataataatggctattataatagttataacgaggataacagtgatggtgatgagtccggcagttataattctgaagaaagtgatgatagtgacaacagctacagtgatgataatacctatagtgaagaggaagaataaaaaagaatctgattttgcagattctcaaaggggatgtcgtttaacgacatccccttttctaggctggaaaatgcgcataaaatttttcttatatccagtgtaaggacagagtctgctgaaactcaatgtttgctagatcagttgacaataaaaataaaagataagaggaataaaacaaaatgagagatttatttgaaaatggaaagaagccggaagtatctgtgattataccggcatacagaccaggaataaaatttgagcgtctgctgaaaaaaattcagaagcagagttatccggtaaaagagattattgtaatgaacacagaaaaaaaatattggaacatggattgggagtttgtaaatccaaatttgaaagtgtatcatattaaaaaatcagagtttgaccatggaaagaccagagcagaagcagtgaaattaagtaccggtgatattatggtgctctttacacaagatgcagtgccggtcgatgaatttgtaatcgaaaatctggtaaaggcatttcgaaataccaaagttggagtagcttatggacgtcagcttccaaatccggaatgtgccttgattgagcgttataccagagcatttaattatccggataaaagcagattaaaaggaaaagcagatttggatgagttgggaattaagacatttttttgttctaatgtctgtgcagcctatcgaaaagacttatatatgaagatgggcggatttattacgcatacaatttttaatgaagatatgatttatgccgggaaaattgtactaaaaggctatctggtagcatatcagtcggatgcaagagtgtttcattctcacaattatggaaatgtggaacagtttaaaagaaattttgatttggcagtctcacaggcagaccatcctgaaatttttggaaccgtgaagtctgagaaagagggaatttgtctggtaaaaaatacagcccgttatttgtgtaaaattcataagccatggctggttgttgacctggtgataaagagtggatttaaatttttagggtatcgcaccggaaaaatctataaacgtctgcctaagaaagtaattttagcgtgtacaatgaatccatcctattggagaaagtaaaataattttttaaaatctatgatttttatcacattttggacacaattccctgttaaactgtgctcataaagaaaaaagggagtaattactatgagtgaagaattcaagaatgaatttgatgaaaataaagaaacagagacagataatgtaaatacgcaggaagaaacagagactgtttttgaagataatgcgtctaagccggaagaaacaacaaatgaaagtgcagtgacacaagaaccgggaaatgcgccaacaccggaaaatccggtttatgcaagagcataccagccgcatgaacagcgggaggccacaaaagaagagtggtatcaggaagcacagcaggaacagaaacagcagcaaagttataatgcttatcagtttactgctccggaatcaaagaagccaaacagatccggaaagaagttaaacggacaaggcagaaaatttggcacagtcgttgcgacagcggttgtgtttggtctggttgcaagtgcagtttttcaggggacaaattatgtgggaagtaaattaaatccacagggaaaaaaatctgttcaggtacagtctacacagacaatcagtcaaaataaatcatctgattcagaagaaagtgtatcaggaagcactgagggaacttcaagcgtaagtcaggttgcccaaaatgcaatgccgtcaattgtatcgattgtaggagtcagcgttcaggagattccacagatttatcagtactttggatatggacaacagcaggaaactcagagcagtggttctggaattattgtaggacaaaatgataccgagcttttgattgcaacaaataatcatgtagtcagcggaacaaattctcttaccgtgtgcttcacaaatcaggacggaagtgcagtaaccggaaatggtgacgtggaaaagaccagtgccgaaggtgaaagcggcagcacaaatcaggatggtcaggacagcagtttggatgatgttcaaagcggtgcggtatctgcacagattaaaggtacggatgcagataatgatcttgctgttatttcagtaaaattggaggatattccggaagatgtattaagtgagattaaagtggcaacaattggagattctgattcccttcagatgggtgaacaggttgttgcaattggaaatgcacttggatatggtcaatcagtgacaagtggttatgtcagtgcattaaaccgtcaggtaagttcagatgatacagatggaacttttattcagactgatgcagcaattaaccctggaaacagtggtggtgcacttttgaatatgaaaggtgaactgattggtattaactctgcaaagattgcttctgatgaagtggaagggatgggatttgcgattccgatttcaaaggcagaaccaatccttgatgagatgatgaatcaggaaacccgttacaaagtagaagatgaagataaagcagcatatattggaattacctgtgaaaatgtaaccagtgatgtcaaccagatgtatggaatccctcagggagtttatgtagatactgtagtagaaggtggaccggcagaaaaagcaggaatcaaaaaaggtgatgtcattactaagattgatggtactgcgattgatgcatacaaagatttggtagacagactggaatactatgaagccggagaaaccgtagaattagaagtttaccgtgcacaggatggagaatataacgctcagaaaatcagtgtgactttaggagcaaagaaaaatgcgccgagcacaaattcttcttctaatcagcagcaaaatgaaaaaaataataaatagtaaaaagagatatcagaataccgtaggaatgttgtttgttcctgcggtatttttttgataagttccaagaaaagtcaaatgccttaccatgcaaacatgaaagtcatttgaactttctgacccttggtatcataatataatactgtatcttttattttcagggattattattatggaaagatattgtatgcaaaatcattatacttgccgttcaaacaggatgtcagagaatcgttctatgcaaaaccgtccgtttagtggggactgctttgatgatactgctatttataaacatgcagaccatctgcctcttacaatggcttatgttccgatgcagaaattctctggaacattttctcttcagaagagtctgtcttgtggaactgtttttccggagctttgtaaaccattttgtggaaagagaggtcgttgcagatgaatcagtgtcgagaacaaactgccctgcttcaatatatcaatgaagttagttttgcaatcaatgatatgaatttgtatttagatacgcatccagaagataagaaggcattggcatttatggaagagcacgtaaaaatgcgcaaacgtgcgttaaaagaatatgctatgaaatacggaccacttacaattgatacgaccgatgacggacagagctgttcatgggactgggtgatgcagccctggccatgggaataatcaaattggaataaagaaaaagagtagaaaggaaagtatttgttatgtggaattatgaaaaacggcttcagtttccggttaatattaaaacgccaaatgcgaaactggcgttatttatcatgagccaatacggtggcccggacggtgaaatcggagcatccatgcgttatctttctcagcgttttaccatgccaaaccgtattgcaatgggaacgttaaacgatatcggtacggaggaacttgcacaccttgagattgtttctacaatcgtgcatcagctgaccagaaacctttctatggaagagattgaacagtcgggtcttggaccatattatatcgaccataccgtgggaatctggcctcaggcagcaggaggtattccatttaatgcctgtgagtttcagtcaaagggcgatccgattacggatttatttgaagatttggcagcagaacaaaaagcaaggagtacttatgataatatcctgcgtgtcgtaaaagattctgaagtagcagagccgattcgtttcctgcgtgcaagagaaattgtgcatttccagcgttttggtgaagcacttcgttcagtacaggaagaattggattcgaggaatttttatgcatttaatccaagttttgatgcaccttgccaggccttttgcgaatctatgacaaagaatgggaattaagtcaaacgtaaaataatttgacaattgattatgattctgttatcatagttttcgctgactaagttttgtgagatgccacaataagcattacgagcgcttactgtggcatctatttttctgtcaattcatagaaaagcaggtgaaaaagtcttgagattgtttctattgttatttctattgattcacagatgcctactaatagaaaggaaatttatatatggaaaccattacatttgaagaactcggcttatgtcctgaaattgaaagagcagtccgttttatgggatttgaggaagcttctccaattcagacaaaagcaattccggctattatcagcggaaaagatattatcggacaggcacagaccggaactggaaaaaccgctgcatttggtattccacttcttcagaagatagacccgaaaaataaaaagcttcaggcaattgtactttgtccgacaagagagcttgcaatacaggttgcagatgaaatccgtaatcttgcgaaatatatgcacggaatcaagattcttccaatttacgggggacaggatattgtgaaacagattcgttctttaaagaacggaactcagcttgttatcggaactccgggtcgtgtgatggatcacatgcgcagaaagactgtaaagatggaccatattcatacagttgtgcttgatgaagcagatgaaatgttaaacatgggatttcgtgatgatattgaaactattttaagtggtgttccagaagaacgtcagactgttttattttctgcaacaatgccaaaaccaattttggaaatcacaaagaaataccagaatcatgcagaactgattaaagtaaccaaaaaagagctgaccgttccgaatatcgaacagttttattatgaagtaaaaccaaaaaataaagaagaagtgttatcccgcttattagatatttattctccaaatctttctgttgtattttgtaatacgaaaaaacaggtagataatctggtaacagctttaatcggaagaggatattttgcagccggattacacggagatttaaaacagtctcagcgtgaccgtgtgatgcagagtttccgtaccggaaaaacagagattcttgttgcaacagacgtcgctgcacgaggaattgatgtcgatgatgtcgaagctgttttcaactatgatttgccacaggatgaagaatattatgtacatcgtatcggtcgtaccggacgtgccggaagaggcggacatgcattttcttttgtcagcggaaaagaaatgtataaattaaaagaaattcagagatactgcaagacaaagatttatgcacagaaagtgccgtctatcaatgatgttgcaaacactaagatggaacatatccttgcaaaggcagattcagtaattgagcgtgaaaatctttctcttatgttagatgccatcgaagaacgtgtcaatgcgtctgattatacgacaatggatatggcagcggccctgcttaaaatgtatatgggaatggtaaaagaagaaaccgaagaggaagaaataacagattttggagataccggtgcagaagaaccgggaatggttcgtctgtttattaatattggtaaaaaacagaaaattcgtccaggtgatattttaggcgcaatcgccggtgaaagcggaatgcctggaaaattaatcggaacaatcgatatgtttgataaatatacctttgttgaagtaccaagagaatatgcctcagaagtcttaaaagcaatgaagagtgcaacaatcaaaggaaatcatattgcaattgaacctgcaaatcgtaaatagcttttttgagtccagtaaaaagtgctggactcatttttttattgcatagaatagtataggtaagtatcaaatggaaaattacattttgttagattttgatttacaagtcataaaagaacatatactgttgtaagattccggcatatcctttatatttttcataaggaaatccatccggataatgttcagctaaaattttttttacgtgtgtatcaatcggaaaagcatctacgtgatgcagagcaaataaggcaatgcaggctgccactttatttccgatgccatattggtctgtcagcattttatgagcagtcgcagtatcctgtttttttaatgtttcaagggaaaaagagccgtctgctacggaacaggccattttataaatatatttgtcacggtatccaagtccaagaccggcaagtccttccattttggcagaggcaagagtttcactttcaggaaaagtgtaataaattttgtcttctggggttatttttttctctccgaatttttcacagagagccactacgctttttcggattctcggaatattattattttgcgaaattagaaatgtaatgatgatttcccataaatcctgatttaaaattcgcatgccccatccataattcacagctttggtaaggtaactatcgtttttgtctacagaggcttttattttgtgataatctgttttcaaatcaaaataagattcccagatttctttaaactcagtttcagaacagtcaaagagtacctgctcatttttttggatgattcgcagatgctttccaaatgcaacattagagaaactgccatctttttctttatggatgcggaaacattgtccggattttgcaatttgttcaatactaaaatcttcgatttgtttttctatcatgattgtttttctttctttaataattttgtgttggttatagaagttataagatcttttaatctttataaatgaaaaaatggattctaccttttccagaacggtcccggtaaaatcctgtaatatccacaagagcagcggaagagatgcagttagaatatctttttttatcaagggaaaacttctcccgaacgggaccgacctcataagaaaagactctaaaattactatatcgaactttactagctttgtcaagaaaattgtcgatatcttccaaaaaaaacgacattatacgataaaattcgtataatttgacaaaaatcgacaagcgaacactttttataaaataagagaagaatcctgcattaggattcttctcattcgacttaagctttataactctcttgtttcaagctgtaatacggcctgacctcttggaataattcttggcccgccagagtgttcaatatattcttttgtaaggataacttctccgatattatcatcttttgggatttcatacatgatatccagcatgtattcttctaagattgcacgaagcgcacgggctccagtatgtttttccaatgccatttttgcaatcgcatgaagtgctccttcttcaaattcaagttttacttcatccagtgccagtaatttctgatattgttttaaaattgcattttttggttcttttaaaatctgaacaagcatttcttcagatagaccgtccagtgtaaagataatcggaagacgtcctaaaaattccggaatcataccaaatttctttaagtcatcaacagttactttatttaaaagcttgctgtcattgtcatatttatcttttaagtctgccatgaatccaatagaagcctgtttatttaaacgttctttgataatggattcaaggtcgggaaatgctccgccacagataaataaaatatttttggtatctacagttgcaagtggaaccattgcatttttgctgttggcacctaccggaacttcaacctcgctgccttctaaaagttttaacattccctgctgtacagcttccccgctgacatctctttgattggtatttttctttttggcgattttatcaatttcatcgataaaaataattccgtgttctgccttttccacgtcattatcagcggctgcaagcagtttgcttacaacgctttcgatgtcatccccgatatagccggcttcggtaagagaagtagcatctgtgattgcaagcggtacatcaagcagtcttgccagtgtcttgaccagataggtttttccacttccggttggtccaatcataagcatattggatttttcgatttcaatttcatcggcattgtctgcaaatactcgtttataatgattgtaaacggccacagacattactttttttgcatattcctgtccaattacataagaatccaggctttctttgattttatgaggtgccggtatactgcggatatcaaatacctttttggcgattttttcatttgcttctttttcaggctgagcttttttctttttaattctctgtttttttggaatttcattttgtaatgaatttaaatcaaccatgctgatgttgggcatgtttttcattaattcactgtaatccatcggcatattgttcatagaattaaaactcttctgcatacagtccatgcagacgtgaattccgcccggaatatcgatcatttttccggctttgctttccggacgtctgcagataaagcagacattttcataatcttctttgttttcttcttcctgttctaaataatccttatcttctgccatagtttcccctgctttccatctatctatatgatttttgttctctgtataagcttatatgtctgtgggtatcttaacataattcataaattcgaacaagtaaacttttcatgaaaaaagtctaaaatgaaaaaacccaaagataggtcttgtatgtaaggtggtagatttggtaaaataaaaacaataagttaaaaaagcaaagaacaggaaaaaaagatgatactaagaattaaaagtatgtggaagatgataaaatataatatgataagtctgcttttgtttgaagcaggatatcgggttgctacttttttaattattacaaatttgacttcaacagcagttaattactctttaaaaaagcgcaatttcagttatctgacagcagaaaatttccacaaatttttacaaaatccaacttccctgatttttctttttggaattttattgctgattttatttttctttttaatagaaatttcagcggttttatcatgtttttcccattcctatcaaaaacgaaaaatctataccagtgatatgttgattgaaggaatccgacggacgttgcattttttaaaacacagtcagagctcctggattatatgtattttgatggcagctccgtttttgtcggtctattttttaattatggaaatctcttattttggagtgcttcagtacagtgtgatgcagatctataaatgggtgaagccacactggattttatatctggcggttggagttattttggtgatttcttttctggcggtattttcgcttccctattgtttgctggaggaaagaaaaagcagcagaggattaaaatcaggatggattcttttaaaatggcactggaagcgaattattttaggttttgtggcactccatatcgtgatgcttgcagttatcatgggtgtttattttctggcaaatgccacagcttccggttatgcaattttaagcaaaccaaagtcagcagttgtaagcgcagtgcttgtctataatgactggattcgtatggaaatcggtatctttgcaggagcactccagctgatgctgagccttgcctttgtttattttatttatgcgcgttaccatatccagaaaaaaagtgaagcgggaattgctgctattttcagacagaaattatggtatcagaaaatcggtcaaagaagagcagcggccatctttactgcgattttactcgtcatggaaggttcttatctggttgtactggcttctgaccatagcagtgccgtaaacagtctgatgagtacaaccggagtcactgcacacaggggaggggctcttatggcaccggaaaatacaattagttctctggattatactataaaatgtggagcagattacgcagagattgacgtgcaggaaacagccgatggggaattggttctcctgcatgataattctctaaaacgaacggcgggtgtaaagaagaatgtatgggaaatgacttatgcagagattgcacagcttgatgcaggttcaagttttaataaaaaatttcgtggggaaaagattccaacattagatgaagtattgaaattctgcaggggaaaactggatttgaatattgaaattaaatacaatgggcaaaataaaggaattgtaaagaaagttgtgcgtataatagaacagaaccatttcgaggatcattgtgtggttacttcgatgaattattcgtttttgaagcaagtgaaaaaggcaaatcctgacatccgtaccggatatatcatgacgatgacttatggaaccatttcacggatagaagcagcagactttttcagtgtgaaatatacttatgtggatgaggcgtttgtgagggaagcacattctcttggtaaagaagtacatgcctggacggtgaattatcgtggagatattaagcggatgctggatgtgggcgtggataatattatcacggataatccggttttagtgagaaaagttaaaaaccaggaaagtgatatgcagactgacttttgggatttaatgcgctatgcatttaagatgtgagaaaaaactgttgacaaatagtggcaaagaagatatactttgagcatcaaagtaattttgagcctaattgaaaaaaataaaaaatgagatatattttataaggagattaaagattatgttagaaaaaatgagagaaattattgcagaacagttgaattgtgacgaaggagaaatcaacgtagatacttcttttaaagatgacttaggagcggattccttagatttatttgaattagttatggctttagaagatgaatattctgtagaaattccggcagaagaacttcaggaattaacaacagttggtgctgttattgactatttaaaaaataaaggcgtagaagaataagaaagactggaatctgccgcaatggtaagaaataactcttgcggcagattctttttaggtaaatagtttgaaatacaaaatattctagtttcaaaggagttttatatgagcaagacagcttttatttttccgggacagggagcacaatataccggcatgggaaaagatttttacgaagaaattcctgtgtgcagggaaatgattgatttagcaggagaagttactggtcttaatatgccggcactgttatttgaagaaaacgaagagttaaatattacagaatatacacagattgcaatgcttagtgtggaagttgccattttaaaggcattggaagcacagggagtgaaagcagatgtgactgccggcttaagtctgggtgaatacgctgcctgtgtctgtgcaggaactcttttagaaaaagatgcttttttactggtcagaaaaagaggaattttaatgcaggaggcagttccgagtggcggtgcaatggcggcagtaatgggaacaggtgccgatttgattgaagaaatctgtgaaaagacggaaggaattgtatcgattgccaattataactgcccggggcagattgtcattaccggagaaaaagaggctgtagaaagagcatccgaggcattaaaagaagctggagcaagaaggattgttcctttaaaggtatctggtccatttcattctgcaatgcttgagcaggctggagaagcacttggagaagtattggatgcaatagaggtaaagaaaccggaaattccttatgtgacaaatgtgacagcacaatatgtgaccaaggcagaagaagtcaaaccactgcttgttaaacaggtttcctcttctgtaaaatggcagcagtgtgtagaagcgatgattgaagatggggtagatacctttgtggaaatcggacctggaaaaaccttaagtggatttatgagaaaaattaaccggaatgtgaccgttatgaatattcagaataaagaagagtttgaaacggtagtaaattgtttgaaatgatttaaccaaatcaagcaagtagcgaaagcggattgcgaatatccgcttgacaataaacggatttgaaatttgaaattaagaaaggcagaatcatgttagaaggaaaaatcgcattagtaaccggcgcaggaagaggaatcggaagagcagttgccttaaaacttgcagggcagggtgcagtggtagtggtaaattataacggctcgaaagaaagagccgaagaagtcgtaaaaaccattttggaaaatggaggaactgcatctgcatatcagtgcagtgtcagtgattttgaagcctgcgaaaaaatgataaaagatgtgattgcacagtatggacatcttgatattttggtaaataatgccggaattacaagagatggactgattatgaaaatgaaagaagaagattttgatgctgtcattgagacaaatttaaaaggaacatttaatacaattcgtcacacaacgagatggatgttaaaacaaaaaggcggaaaaatcatcaatatttcttcagtgtccggaatccttggaaatgcgggacaggcaaattatgcagcaagcaaggctggtgtgattggtctgacgaaaacaatggcaagagaacttgcaagccgtggaattaccgtcaatgcggttgcaccgggatttgtggaaacggatatgacagaggtgttaccggaggctgtgaaagaaacttcctgtaaacagattccgcttggaagatttggaaaaccagaagaaattgcaaatgcagttgcatttttagcatcagaagaagcagattatatcacaggtcaggtcatcagtgtcgatggcggaatgagcatgtaggaggacgttatgagacgagtagtaataacaggaatgggagcaatcactccgcttggattaaatgtagaagagttctggaacggattaaaagaaggcagacatggatttggagaaattacccgttttgatgcctctgaatataaagcacatcttgccggtgaagtaaaaggatttgtcggaaaagaatttatggatgcaaaggcagcaaagagaatggaactgttctgccagtatgcggtcgcagccacaaaagaagccatcgaagaggcaggtcttgacatggagaaagaagatgcttaccgtgtgggctgttcggttggttcaggaatcggaagccttcaggcaatggagcgtgaacacaccagattattagaaaaaggaccaaacagaatcaatcctttattagtaccaatgatgatttccaacatggcagcgggaaatgtatcgattcaatttggattaaaaggaaagagcttaaatgtcgtaactgcctgtgcaacaggaacaaactgtatcggtgaagcttatcgcagtattcagtttggtgatgcagatgtcatggtagcaggtggaacagaagccgcaatcagtccgattggaattggcggatttgctgcattgactgcactttcaaaatccacaaatccagaccgttgttcgattccgtttgataaagagcgggatggatttgtaatgggagagggcgctggaattgtcgtattggaagaattggaacatgcgaaaaaacgtggtgcaaagattttagcagaagtcgtgggatatggagcaaccagcgatgcctatcatatcacttctccggcagaagatggagaaggtgctgcaaatgcaatggcaaatgccatcaaggaagcaaaaattcagccagaagaggttacttatatcaacgcacatggaacaagtacccatcacaatgacttatttgagacaagagcaattaaaaaattgtttggggaacatgcctataagatgaaaatcaattctacaaaatccatgattggacatcttttaggagcagcgggagcagtggaagtgattgcctgtgtaaaacagatggaaaacaattatgtacatacaacagcaggatatcaggtaaaagatgaagaatgtgacttggattatgtagcgggaagcggagtaggaatggaaattccgtatgcactgacaaattctctggggtttggtggacataatgccagtctgttgcttaagaaatggaatgactaggaggtagcttaaaatggaatttgaaaaaatgattgaattaatcaagaccgtcagtgattctaatctgacacagttccagatagaagaagacggctttaagctttccatgaaaacagataaacagtccaaagtagtagttcagaagcaggaaagcgtaccaaaagaaattcaaagtgttgcgatggatgagattaaaccggcagaacaaaaagaaatcaaaaaagcagagggaaatgttgtgaaatctccattagttggaacattttacagtgcctcttcaccggattctgccccatttgtaaaagtaggagataccgtaaaaaaaggtcaggtacttggtattgtagaagcgatgaaacttatgaatgaaatcgagtccgaatttgacggagtcgtaaaagaaattcagattgaaaatgaacaggttgtagaatatggacagccattatttgtcattggttaggagaaatcagatgaagcttacaacaaaagaaattatggagattattcctcatagacagccatttttattaattgacacgattgaagaattagagccgggtgtacgtgcagtcggaagaaaatgtgtcagctacaacgagccatattttgcaggacattttccacaggagccagtgatgccaggtgttttacagattgaggcacttgcgcaggtcggcgctgttgcaattttaagcaagccggaaaataaaggaaaaactgcttattttggtgcaattaacaatgcgaaatttaagacaaaagtcgttccgggtgatgtgttaacgttagagcttgaaattataaaagaaaaaggaccgattggagtaggaaaagcggttgccaaaaatcaggagggcaagattacagtctcagcagaactgacatttgcaatcggataggagtgtggaaaaatgtttcataaaatattaattgcaaatcgcggagaaattgcggtccgtattatcagagcgtgtcgtgaaatgggaattaagacggttgcggtttattcggaagcagataaagatgcgcttcatgcccagcttgcagatgaagcagtctgtattggaccggctccggcttcagaaagttatttaaatatggaacgaattttaagtgcgacggtggcaacaaaggcagaagcgattcatccgggatttggctttctctctgagaacagtaaatttgtccgaatgtgtgaaaaatgcaatgtggtatttatcggaccgtctgcagatgtaattgacaaaatgggaaataaatcgcaggcgagaaagaccatgcaggaagccggagtaccagtcgttccaggcacaaaagagccggtttatactgcaaaagaagctttagaagaagcaaaaaaaatcggatttccgattatgattaaagcatcctccggtggtggaggaaaaggaatgagagtttctgaaagtgaggcagattttgaagaaaattttaataccgcacaaagagaatctattaattcctttgcagatgatacgatgtatctggaacgctatgtgggacgtcctcgtcatgtagaagtacagattttaggagataaattcggaacagccgttcagcttggagaacgtgactgttcgattcagagacgtcatcagaagatgatagaagaatctccatgttgtgcaattactaaagaaatcagaaaaaaaatgggtgaaactgcagttcgtgcggcaaaggcagtcggatatgaaagtgccggaacgattgaattcttactttcagaaaccggagaatttttctttatggaaatgaatacccgaattcaggtagaacatccggtgacggaatttgtctcaggtgtggatttgattaaagaacagattcgtatttcggcaggacttccgatttctgttaagcaggaggaaattcaggttaagggtcatgcaattgaatgtcgaatcaatgcagaaaatccgaagaaaaatttcatgccgtgtccgggaaagattgaaaatctgtatcttccgggaggaaacggagtaagaattgataccgcagtttacagtggttatcagattccgcccaattatgattcaatgattatgaaagtgatcgtatatgacaaagacagggagtctgcaatcgcaaagatgcgaagtacgcttggggaagtcgtcattgaaggggttcagacaaatctggattttcagtatgatattttaaatcagaaagattttttagaaggaaacgtaaccacacattttattgaagaacattatgagtagtaaggagcaggcgaaatgtccagattgaaggatttatttaaaaaatcgacaaatgaatcagccaaaacagaagaaataaatgaagcccagtttggtccgtctgtaccagaaggtctgtgggtaaaatgtccaaaatgcggagaactgctttataaagaagatgtagtaaaaaacagttatgtctgcccaaaatgtcagggatattttagaatgaaggcaaagacgagaatccgcatgattgcagataagggaagttttaaagagtggagtacggatattaagacaaagaactttttgaattatccgaattatgaagagaaaattgccgaagtgcaggaaaagactcacttagaagaagcaatcaaaatcggagaagcccagattgataagacaagagtcgtgcttggagtctgtgatgcccgttttttaatgggaagcatgggatatgtggtaggagagaaaattaccagagcatttgaatgtgcgacaaaagaaaagcttccggttattttattctgctgttcgggcggagcaaggatgcaggagggaatggtttctttaatgcagatggcgaaaacctctgcggcaattaaagcacacagcaaagcaggactgctctacattccggttctgacagacccgacaacaggaggagtgaccgcaagttttgcaatgcttggagatattattctggcagagcctggagcactgattggatttgccggtccaagggtgattgcacagacaattggacaaaaacttccggaaggattccagcgttcggaatttttagtagaacatggaattattgatggaattgtaaaacgaaatgatttacgaagaaccttgtccggtcttgtaaaactgcatgagcgaaatgcaagttatagtcagtttaataaaatttgttttcagggtgaacagaaacagaaaatcgaaacaaagaagcgaagaaccagaaaaaaagaaatgactgcatgggagcgggtagaaatagctcgtgattctaaaagaccaaccagtttggattatattggaaagatatttgatacctttatggaactgcatggagaccgtgcctttcgagatgatggggcaatgattggtggacttgcattattggacggacaaccggttacggttattggagtacaaaagggtcgtaatacaaaagataatattacgagaaattttgggatgccgtctccggaagggtatcgaaaagcacttcgactgatgaaacaggcagaaaaatttaatcgtccgattatcaattttattgatactcccggagcattttgtggaattgaagcagaagaacgcggacagggagaagcgattgccagaaacttaatggaaatgtcggatttaaaagttccggttttaagtattgtaatcggagaaggcggaagtggtggtgcacttgccattggtgttggaaatgaagtctggatgctggaaaatgccacttattcgattttatcgccggaaggatttgcctctatcttatggaaagacagcaaaaaagcaaaagaagctgcggaaattatgaaaattacggcaaaggatttaaaagcacttggaattattgaacaggtgattgaagaaccatatccggcatgtgaagaaaacttagaagaaatttctgagaatatgaaaacgaagatgcgagaatttcttcagagaatggataaaaaaacaaaagaagaactggcagaagaccgttatgaacgtttccgcaagatgtaagaacttaggaagataagaagaaataggcaggaaaaaatatgagcaaatcattaaaaataggagatttggaagtgaaaattccggttgtgcagggcggaatgggcgttggaatcagtctttcaggacttgcaggaaatgtctctgcctgtggcgggcttggtgtgatttcaaccgctcagataggctggagagaaccggatttttatgaaaaaccatttgaggcaaatttccgtgcaattgaaaaagaaattaaaaaggcaagagaactggcaaaaggcggagtgcttggagtgaatatcatggtggcaacacagcgttatgaagagtatgtaaaatcagccgtaaaagccggaattgacattgttatttccggagccggactgccgattgaccttcccaaatatgtagagggaagcaaaacaaagattgcaccgattgtctcttctttgaaatctttgacggttatctgcaggatgtgggagcgaaaatatcagacagcaccggatttggttgtgattgaaggaccaaaagcaggtggacatcttggattttcaagagaagaattagaaactgttacagatgaggcttacgatgacgtgattgtctcgattattgaaaaagtaaaagagtatagtgaaaaattctcaaaaaagattccagtagtagttgccggcggaatttatgagcgaaaagatatggaacacgttatgaaacttggcgcagatggagttcagatgggaacaagatttgtgacaacgaaagaatgtgatgccgacgaagcctacaagcaaagctacatcaaggcaaaaaaagaagatataaagattgtacaaagtccggttgggatgccgggacgtgcgattctaaatccatttctggaaaaagtaaaaacagaaaaatgcaaaatcaaacactgctatcagtgtattgtgacctgcgataaaaagacgattccatactgcattacagaagcgctggttaatgcagcagagggcagagtagatgaaggtctgctgttttgcggagaaaatgcatatcgtgcagataagatagaaacagtagcagagattatggaagagtttcgataaaccgataacaaaaagagtcctgaaatcaggattcttttttgtttatcaggtatttcaagaatagttaacacttgaaaagtcaaaattcataaggtataattttagtcgtatcgatggagtcgagaaaaaagtctgaaaaagacgatttttaaggagatagaaaatgagtacagtaagaacaagattcgcaccaagcccgacaggaagaatgcatgtcggaaatttaagaactgcattatatgcttatttaattgcaaaacatgaaaacggaagttttatgcttcgtattgaagataccgaccaggaacgtttcgtagacggagcactggatattatttaccgtacactggcaaaaacaggtctggttcatgatgaaggtccggataaagatggcggatatggtccttatgttcagagtgaaagaaatgcacagggaatttatttaaaatatgcaaaacagttaattgagcagggagatgcttattactgtttctgtaccaaagaacgtctggaatctttaaaatccaacgttggagaagatggaaaagaaatctctgtttatgataaacactgcctgcatttaagcaaagaagaagttgaagcaaaactggcagcaggagaaccgcatgttattcgttttaacatgccgacagaaggtacaacaaccttccatgatgatatttatggagatatcaccgtacagaatgatgaattagatgatttaattctgattaaatccgatggatatccgacttacaactttgcaaacgtaatcgatgaccatctgatgaacatcacacatgtagtaagaggaaatgaatatctttcttcttcaccgaaatacaatcgtatttatgaagcatttggatgggaaatcccgacttatgtacactgtccgttaatcacaaacgaagaacataaaaaattaagcaaacgttccggacattcttcttatgaagatttattagagcagggattcttaacagaagcaatcgtaaactacgttgcactgcttggatggtgtccacaggacaatcgtgagattttcagccttgaagaactggtaaaagaatttgattaccatcacatgagcaaatctccggctgtgtttgacatgacaaaattaaaatggatgaatggcgaatacattaaagcaatggattttgataaattctatgaaatggcacttccatacattcagagtgtaattaaaaaagacttagatttaaagaaaattgcacagatggtaaaaaccagaatcgaagtattcccggacattccggatttaattgacttctttgaagcagttccagaatacgatgttgcaatgtatactcataagaaaatgaaaacaaatccggaaatttctttagaagtattaaataaaatcattccggtattagaagcacacgaagattacacaaacgatgcattatacgaattactgtgtggatttgcaaaagaaaacggatacaaaaacggacagattttatggccgattcgtaccgcactttcaggaaaacagatgacacctgccggtgcaacagaaatccttgaagtacttggaaaagacgaatccattatacgtttaaaagcagcagtagaaaaactttcttaattcaacaaatatagcaaggattctcccacctctataggtggtgagagaaattgcaaacagaaaggttaacggcagtgatgggcggagagaaatcggtatcccccactgacatgaggtaaaccacagtcagcgttttgctgacatgtcagactctgtgaaattaccgactgtgggttgaaacaatttgaactggagaaaagtaaatgaaagaaaattcagcacaaaaccgtgcgatttcccatgataaaggaccgatgatgcttcttgccggtcctggttcagggaaaacaacgacgattacaaagcgagtggtgaatttaatacaagaaaaaaaagtgactccttcttctattctggtggtgacctttacaaaggctgctgccagagagatgaaggagcgttttttacgcctgtgtaaagaaaaaaatgtgaatgcgccttatgaacaggttacctttggtacgttccatggtgtttattacactattttaaaatatgcttatcacttaaatgcgcagaatattttaagtgaagagcgtaaatatgatatcttaaaagaaattgtatatcgccagaagcttacgatagaagatgaaaaagaattttttcagggactggtacaggaaatttccatggtaaaaaacggacggattccactcgaacattattattcagccaattgtccggatgatacattccgtgcgatttatcaggcttatgtgaagcgatgcaaagcttcaaaactgcttgattttgatgatattttattatatacttatgaacttttgacaaaccgaaatgatattttaagaggctggcagaagcgtttttcctatattttagtagatgaatttcaggatattaatcaactgcagtatgatgtggtaaaactgcttgcaaagccggaagataatttatttatcgtaggagatgatgatcagtcaatttatgcatttcgaggtgcaaagccggagattatgctgcattttccagaggattatccggatgcaaagacagaactcttagcttgcaattaccgttccgcttctaccattgtagaactttcccagaaagtgatttcagaaaactcaagacgttataagaaagaattatttgcagatagaatgggtggaaatcctgtaacaatacaggcgtttgaagatggaaaacaggaagaattatatgtaaaaaatcaggtgcagaagctgttaaaagaagggattccttatgaagagatggcagttttgtaccgcaccaattccggagcacgttttcttgtggaaaccctgatgcggtaccagattccattttgtatgcgggatacgcttccaaatctttatgaacactggattgcgcaggatgtgatttcttatatccatattgcaatgggtgagagaagccgaagagagtttttacggattatgaatcgtcccaaccgctatttttcaagggacgctttggatgaggcacaggtttcttttgagggactgcgttggttctatgaggaaaaagactggatgtgtgaccggattgataaactcgaagaagatttgaatacattaaaacgtatgacaccctatggcgcgattaattatatccgttatggaatcggctatgaagaatacttaaaagagtacgcagggtatcggaaaattaagtcagaagaattgtttgaagtgatggaagaactggcttcaagtgcaaaaaactttaagtcattttcggaatggtttgtccatatagaagagtatacacagcagttaaaagaacaggcaaaaaaacaggtttcagagaaaaaaggaattacgatatctactctgcacagtatcaaaggacttgagtttgatgcagtctttttaatggatgttaacgagggttcccttccctatcataaggcagtgacagagagcagtatagaagaagaacgacgtctgttttatgtgggaattacaagggcacggaaatttttatggattttatatgcaaagaatcggcatgacaaagaattggaagtctccagatttttaacggaaagcggtctggtattaaaagaagagaaggataagaaaaaatgacaaatcagatatggatttactatggaaaaatagaaaatctggtaaaagaagaaagttcaaaacaaaagcgggaacgaacagccggaagactactgttgttaaatgcaataaagaaaagcaacatccaaaccattcaaaatctggaagaactagaacagtctattgaaatcggagcacatggaaaaccgtattttaaagacaaaacccgctttcctttttttaatatcagccattccggagactatgcagtctgtgcagtggcaacttgtgaaatcggaattgatatccaaaaaatacaatcttacagtccaaggcttttaagacggatcttaacgaaacaggagctgttacagcttgaacagtcagaggaaaaagaatctttcttttgcagtctctggagccaaaaggaaagctatgtaaagtggagtggtcagggaattacgagagaacttgacactttagaaaaaaatgcatggcaggaaagtttttcaatcgaggattactgggtctgtgtaacagcacagtctgcgtgtgaaattgagtgcataaaagaatcagaataaaaaaagataaaggaaaacggcaagaaagaaattcctgtattaaataaagattgtcctcatatattattttaagaggtgaacaagatgaaagaaaagggaattacatatctctttcctgctaaaatacgggaaatactcgaaaagaccggatttaatttggaagagctttatgaaatcaggcttcgggttaatgctccgatgattgtaatctacggtgggaaagaatactttgttgcgaaagatggaaggctgaccaaaaatatgcagaatgtctgcatgattgaggcagaagatttgcgggaaacaatggaatatgtcagtaattattccatgtatgcattcgaagaggaaatccgaaagggatttattacaattcaaggcgggcatcgggtcggaatagccggaaaaaccgtcttagatggggataaaataaaaagtctaaaatacatatcttatatcaatctgagattatcacatcagataaaggggtgtgcgaccccaattctcccttatattatgaaaaaaaataatgtgtgtcataccttgattatttctccgccgatgtgtggaaaaacaacactgcttcgggatttaatccgccaggtcagtgatgggaatcgttatcttgaggggaaaacggtgggagtggtggatgaacgttctgagattgcaggctcttatcagggaattccgcaaaatgatttgggaatccgtacggatattttggactgttgtccaaaagcggagggcatgatgatgctgattcgttcgatgtctccggaagtggttgcagtggatgagcttggcgattatgaagacattcatgcgattgagtcagtcattcactgtggctgtaagctatttgcaaccgttcatggtagttccattgatgatatgaagcgaaaaccgttgatgcagagactcatgcaggaaaaagtgtttgaacgttatattattttgcaaaataaggacagggcaggacaggtcaaggcaatttttgatgaaagaggaacgtgtctgtatgaccaaaaccgaaaaaagggaattttatgttaagagtggcaggtgcatgtctgatattaagtgcgtcctctttgctgggtgtacaaaaaagcaggcagtttacaaaaagaatcgaacagcttcaggaattacaacggattgtgctgttgattcaaggagagattctttataagaacgcagcacttccggaagccttaagaagcagtgccggaaaagtaaaagtaccgtttgattcttttttaagacagacagcaggaagggcagatgcctttgatggagtccgtttttctgatttgtttgagacagaaataaaagagcagttaaaaggtacagcacttacaaaagaagataaagaggaatttgcccgttttggagaatcgcttggatatctggatgtggaaatgcagaaaaatgcaatgaagctttatttaaaagaactcgaacaaaaaattgaatatctgcaaaaagaaattccacaaaaaagaaaattgtatcaaagtctgggggtcatggggggaatctttcttttgattttgctctggcagtaaaaaagcgaaaaaaagctgaaattgcaggggagggaagtacttggaagttacgattttatttaaaattggagcagtcggaattcttgtttcggtactttgtcagattttaaaacacagccagagagaagaacttgcttttctcaccagtcttgcagggcttttagtcgtactgttctgggtgcttccttatatttacgaactctttcagacgattgaagatttgttttctttgtagggggcaggatggaagttgttaaaattgtgatgattggaattacgggagttcttttggcactctttttaaaagaaagtaagccggagtattctgtttatctgagctttgccgttggaatctgtattttaggatatgcagtggaaaaattatcctatctgtttgagagtatcaaaaaaatacaggaatttcttccggtagatgaaaagtatgtgcttgttctgcttaaaatgacaggagcaacctatattggacagttttcatcaagtatctgcaaagatgccggatatgcagcaattgcaggacagattgagttatttgtgaaactttatcttatggtattatctttaccggtgttactggcactggttgagaccattcataattttttattatgaaaagaagaattcgattcatactggcagtctttttgatctgtctggaatttggagcaacttttgtacaggcagggcaaaaacagagagaacagcaggaagaagaaacaagacagaagctgatggaagatatggaacttgggcaaatgcaggatgcagtcaatcagattttaaaagaggacagcttttccatagaagaaatcttaaatcagattttaaaaggagagtctttgtttcaaaaagagacaatgagtaagtggtttaaaaatatagtaaaagcacagcttcaaagagaacaaaaggcaatgtttcaagttgtacttttggtacttcttgcagctgtgttttctaattttacagcagtatttggagatggaaaaaccggagaaaccagcttttatattacttacatgcttttgcttgcattattgataaaatcgtttggaagtatgggagtggagttaaaagaacttctggaaaattttattttatttttaaaagctttaatgccgtcttattttcttgcggttacggcttcctcaggaagtgcgacggcaatgattttttatgaagcagtgctgtttttaatttatgtgattcaggttgtctttttaaaaggcattgttccggccatttatgttttggcacttgtagaactggtcaattatcttcacagcgaagatttcttatccaaaatggcagagctgttgcagactttgattgaatggagtttaaaaagctgtatggcggtggtgcttggcatgcagttgattcaaaatatgattggaccggcaatggattctctaaagcgggacatcattggaaagacagcggcttcgattcccggaatcggaaatgccattaatggagtgacagaagttgcccttgggacagccgtgattatccgaaatggaatcggtgtagtgggaattattattttagtctgtatcggaatccggccggtgattcgtctggcgctgcttgcatttttatataaactgttggcagcggtagtacagccggtatcggacaagcggatgacaggagcacttagcacaattggtaatggctatgttttatttttaaaggtactgctttgtatggaacttttgatttttatcacgattgcaattctaagtatttcatttatcggaaaataggataaaaatcaggcaagtcaatatgggaggggagtcgatgccggagagagtttgtctatggatgcagagtgttgcctgttattttatctttcagtctgcacttctgcattttctgccagagggaagttataaaaaatacattcagttttacatgggacttttatttatctgggttttgattgtaacaggagggaagcttttaggagcagaggaaaccatgtttgagatgccggatatggagcttcaagaagagacagagagtcaaaaggaatgggagcagaaggcttatgatgcagaaaaccgctattggcaggaacgggaagaagaggtggacaagccatgagaggatttccggacaaattaaaaaaagaatatctggcggttgctctgttagttggaattttgtgtctgatacttgcaattccggtgaaaaaagagacgataaatgagacaaatacagcgatagaagagaaaagtgaagatttaaaagaaggggcatggcaggagcagattcaggcaaggcttcaaaacatgctcaatgaatcggagggggcaggagagacgaaagtatttttaacctttgaaaacagttgggaaaatgtagtagaaaaggatgaaaaccagacggtgtttcaaaaagatgcaacaggaaatcagactccttatgtaaaaatgcagaagtatccgaaaatcagcggagttttgattcttgcaaagggagcagataatccggtagtggtacagaatattcaggaggcagtgcaggcattatttcaggtggaagcccatagaataaaagtaatgaaaatgaattaaaggagaagcgtgggtgaaaaagatttttaagaaaaatcaggtgattattactgctttggcaattatgattgcggttgccggctacattaattactcagacacacatctgggaatggataaggtactacagaaaacaggtgctgtttcggatacctcagatacggaggcgcaggaaaccgcaggaacagatggaattgtagaagagattgacagtctggattatgatttgacagatgaaagtgccctgttagaagaaaatcaggcagcagggaacaatcaggcaggagaagcgagtgcatctgccgagacacctggagaagcagtattaacaggcgcatccacttttgctgcacaggcaaaactgaatcgggagcaggtacgttctgccaataaagaaacactgatgggaattatcaacaacgaaaatataggagaggataaaaaacaggaggcaattgcttcaatggtagaaatgacagaccttgcagaacaggaagaagccgcagaacttttactggaagcaaagggatttgcaaatgtagtggtgaatctgaccaatgaatcggctgacattattgtaccgcaggagtatatggcagatgacaagcgggctcagattgaagatattgtaaaacggaaaacatcggttccgatagagaatattgtgattactccgcttgaagcggaaagctcggatggcgaataaatctttttaaaatccttgacactgtttgtacggtatactaaaatatgctaagtgtttacttatgaaaattttaatttgagataaaaaaagagaaggaggtcatttcagtggctgactatacaaaagaaattacaaaaagaagaacttttgcaattatttcccatccggatgcaggtaagacaactctgactgagaaatttcttctttacggaggagcaatcaaccttgcaggaagtgtaaaaggaaaggcaacagctcgtcatgcggtttcagactggatggaaattgaaaaagaaagaggtatttccgttacatcttccgtacttcagtttaattatgacggttattgcattaacatattggatactcctggacatcaggatttctcggaggacacatatcgtactttaatggcagcagattctgcagttatggtcattgatgcttcaaaaggagtggaggctcagaccagaaaactgtttaaagtttgtgcgatgcgccatattccaatttttacgtttattaacaaaatggacagagatgcaaatgatacctttgatttactggatgatatcgaaaaagagcttggaattccaacctgtccgattaactggccaattggttccggtaaaaaattccgtggtgtttatgatagaaatacagaaaaagtgctgacattctcagataccatgaagggaacaaaagagggaatcgaagaagaaatcggaattgatgaagcacacttggatgatgtagtggatgcagaacagaaagagcagttattagaagaaattgaactgctcgatggcgcaagtgcggaatttgaccaggacttagtcaacgaaggaaagctttcaccggtatttttcggttctgcgcttacaaactttggtgtggagacatttttgaaacatttcttaaaaatgacttcttccccgcttccaagaaaggcagatatcggagagattgacccgatgaaagaagatttctctgcctttgtatttaaaattcaggcaaatatgaataagaaccaccgtgaccgagttgcatttatgagaatctgttccggtaaatttgaggcatccaaagaggtgtatcacgtacagggcgagaaaaaaatgcgtctctcccagccacagcagatgatggcgcaggaccgtcatgtggtggaagaagcgtatgccggagatattatcggtgtatttgacccaggtatcttttcaatcggtgatacggtatgtgcaccgggaaaaaaattccagtatgaaggaatcccaacgttcgcaccggaacactttgcaagagtacgtctgcttgacagcatgaagagaaagcagtttgtaaaagggatcaaccagatcgcacaggaaggtgcgattcagattttccaggaaatcatgggcggaatggaagaaattattgtcggagttgtcggtgtgcttcagtttgatgtcttaaaataccgtctggaaaatgaatacaatgtggatatccgtcttgagacactgccttatgaacacattcgctggattgaaaataaagatgaagtagacgttaagaaactgaccggaacttctgacatgaagaaggttatggatatgaaaggcaatcctctgttattgtttgtaaacagctggagtgttggcatgaccttagatagaaatgaaggattaagactggctgagttcagcagaaactaagaaggactccgttttctgtttaaaagacaggaggcggagattcttttttatattttctatagaagttttgacaccacaattatattttgatataatgtcaggtaggagattatccttttaaaaaataggaggtttggttatggcggaagatagaaatatctataagatacatgataatggctcattgggcgaggttcagattgccgatgaagtggttgctattattgcgggactggcagcaacagaagtagaaggtgtcggttctatggcaggaaatatcacaaatgaactggttggaaaactgggaatgaaaaacctttcaaaaggggtaaaggtagatattttagaaaacattgtctgcgtggatttggctttaaatatcgagtatggatacaatattttagagacaagtaaaaccgtacaggaaaaagtaaaagcagcaatcgaaaatatgacaggtcttgtagtctctgatgtaaacgtgcgtattgcaagtgtagagatggaaaaagaaaagacaaaatagttctttgaaaaatgaaacacagatagagtaaaaatgaaaaggtgtctcgcaaaaggacacctttttttataaatggaggataagatgaaaagaagagaaatgagagaacatatatttaagttattgtttatgggagaattcaatacagtagaagaaatgccggaacagagcagtctgtattttgaaacattagaagaactttctccacaggaagaagaatatatgcgtggaaaatatgaaaaagtattagaacacgtagaagaaattgatgagttattaaacaaggtatcttccggatggaaagtaaaccgtatgagcaaagtagacttaaatatcttaagacttgctgtttatgaaatgaaatacgatgaagatgtaccgtttaaagttgcaatcaatgaggcagttgaattaagtaaaaaattcggaggagacgaatcttcttctttcgtaaatggtattttaggaaagattgccaaggagcagtaaaaggaatatgaatcggacctattcggttggacagattaaccgttatattcaaaatatgtttacgcaggattttctgttgaataaaatctctgtaaagggagaagtttcaaattgcaaatatcatacttcggggcacatttatttttcgctgaaagatgctgcgggaacgatatcctgtgtcatgtttgccggtgcgagaaagggtcttgctttttccatgaaaaatggagacaacgtggtagtcaaaggcaaagtggaagtatatgagcgggatggaacgtatcagctttatgccagagaaattaagttagaaggtgccggagcattatatgaaaaatatctggcgttaaaagaagaattagaagacatgggaatgtttgcaccggaatataaacagccgattccaaaatacattcagaaacttggaatcgtaactgctgcaaccggtgcagcggtgcgtgatattcaaaatgttgcgggaaggcgaaatccgtatgttcagctgattctttatccggcacaggtacagggaatcggagcaaaagaaagtattgtaaaaggaattgaaatgctcgatgcttatggcgtagatacgattattgtcggtcgtggtggtggaagcattgaagaattatgggcgtttaatgaagaagaggttgcaagggcaatttttgaatgtcgaacaccgattatttctgcggttgggcatgaaacagatacgacgattgcagattatgcggccgatttgcgtgcaccgactccgtctgcggcggctgagcttgctgtatttgagatacaggatttattgggaagattggaagagtatcatgcaaaattaaaccgtgaactgcaacagcagattgctcaaaagcgacaaggcttaaaactgtatgaaaataaattaagttacttgaatccaaaaagtcagatagaagagaaaaaacagcattatgaaagtattcagatacggctggaatctgcaatgaaaaccaggattttaacttccagacaggaattgaggctttatattgagcggatgaaaggtctgtctccgttggataaattaaatcagggattttcttatgtagaaaatgaagcgcataaggcggtgacgagtatttcacaggtaaaatcaggtgagacgcttctgattcaggtaagtgatggaacaatagaagccaggagtatcggaataaaacaagtagaaagaggtgtgtttgatgacaccggatttgaaacaaaaagaaacacagacgattgaagaagcttttgaagaactggatggaattgtggagcagttggaacgtgcagatgtttcgcttgaggagtcatttttgatttatcagactggcatgaaactgcttaaagaatgtagtgagaagatagataccgttgaaaaaagaatgttaatgatgaatgaagatggtgggctgagtgaattttaaagaagaattagaacaaagaaccagagaagcggaagaaattatcaaaagctatctgccaaaagaagagggctttgccaaaaatatggcagaggcaatgaattacagcatgctttccggtggaaaaagacttcgaccggtatttatgagagaagtttacagtatgtttggcggaacagggaaagtgatagagccttttatggcggcaatggagatgattcatacccattcgctgattcatgatgaccttccggcacttgacaatgatgagtaccgaagaggaagaaaaaccacccatgctgtttatggagagccagcggcaattcttgcaggagatgcacttttaaattatgcttatgagacggcatttcgtgcatttgacttattagatgagtcagatatggaagaatggaagcgtgtggcaaaagccttatcaattcttggaaagaaaaccggaattgacggcatgcttggcggacaaagcgtagatgtagaaaatgacaaaaaagagcaggaactggacagggaaatgctggattatatttatgaaaataaaacatctgcattaattgaatgtgcaatgacaatcggagcaactcttgcaggagcgagagaagaagagatacagaagatagaaactcttgcaggaaaaataggaattgcctttcagattcaagatgatattttggatgtcacaggtacaatggaggaactgggaaaagcagtagggagcgatgaaaagaaccataaaacaacttatgtgactctggaaggaatcaaaaaggcgggagaagatgtgaaagagctgaccaaggaggcattgaatctgcttatggaacttccgggtgaacaggaatttttaagagaactgcttctttcactttgtacccgcagaaaatagaggtgcaaaagagatgctgttagaaacaattgaaaaagaaaacgatataaagaaaataccgttagaacagatgcctgtgctggcacaggaaatcagagattttttattagagtccttaagtaagaccggagggcatctggcttctaaccttggggcggttgaacttaccatggcactgcattatgtgttttcacttccaaaagacaaaattatctgggatgtcggtcatcagtcttatacacataagattctgaccggaagaaaggatggatttaaaaatctgcgtcaatatggagggttgagtggatttcccaaaagggaggaaagcccttgtgatgcttacgataccggacacagttcaacttccatctcagcaggagtcggctatgtctgtgcaagcaaagtaagtggagaagagtatcatgtggtatcggtaatcggagatggtgcgctgaccggcggaatggcctatgaagctttaaataatgcagcgagcttaaataaaaattttgttatcgtattaaatgataataagatgtcgatatcggaaaatgtgggcggaatttcaagctatttaagtaatctaagaacagcagaatcttatacggatttaaagagcgaagtcaaaaagacattaaataaagtaccgggaatcggaccggtcatggtacaaagaattcataagacaaaagacagtattaaacagcttatgattccaggaatgttttttgaggatatgggaattaaatatttgggaccggtaaatggacatgactgtggaagaatgattcagatttttcaggaagcaaaaaaagtaaacggaccggtgctggtgcatgttcagaccgaaaaaggacgaggatatgaaccggcaagaaaacacccggcaagatttcatggaacatctgcatttaatctggagcatgggattccattaaaaaccgggggaaaggcaaattatacagatatcttttcgacagttatgctaaagttggcagacagaataccaaatcttgttgctttgacagcggcaatgccggacggtaccggtttaaaacggtttcgaaaccgctttccacagcgcttttttgatgtgggaattgcggaggaacatgcggtaacctgtgcagcaggaatggcacttggaggcatgataccggttgtggcaatttattcttcatttcttcaaagggcagtggatcagataatcgaagatgtttgtctgcagaacctgcatgtgatttttgcaatagaccgtgcagggcttgtaggaagtgatggagaaacccatcagggatgttttgatttatcgtatctgtcgatgataccgaatatgacggtgttagcaccaaagaacaaatgggagctttcagatatgttgaaatttgcagtgcgttatcaaggtccaattgcaattcgctatccaagaggagaggcttatgatggtttagaagaatatcgtgagcctatggtttatggaaagagtgagttgatttttgagggcgaagaaacggcattgttgtcagtaggcagtatggtagagacggcagtagaagtaagggagaaattaaaagcagacaaaatcaatgcaactttagtcaatgcaagatttataaaaccactggataccaaaatccttgaccggcttgcattgaagcataaaaaaattgtgacaatggaagagaatgtgaaaaatggtggatttggaatggcggtttccgagtatatgcaggaatatcatccagaggtaaaagtgcagattatcgctcttccggatgcatttattacacatggaaatccaaaattgttaaaagcaaaagccggaatcgatgcagattctatttatggggcaatcaaggaggcagagaagagatgaaagaacgtctggatgtactgttagtaaaaagaggactggcagtatcaagagaaaaggcgaaagcagtcattatgtcaggctgtgtttatgtagagaatcagaaagaggataaggcaggttcgatgtttgcagatacagcaaacattgaagtgcgtggcaatactttaaagtatgtaagtcgtggtggattaaaactggaaaaagcgatgaataacttcggagtaacccttcaggataaaatctgcatggatgtaggttcttctaccggtggttttacagattgtatgcttcaaaatggagcagtaaaagtttatgcaattgatgtaggacatggtcagttagactggaaattaagaaatgacgagcgggttgtctgtatggaaagaaccaatatccgatatgtgacaccggatgatttgcaggagccggcggatttttcttcgattgatgtttcttttatttctttaacaaaagtactgcttccggtttatcatctgttaaaatcaggtggagaagtggtatgcctgattaaaccgcagtttgaagcagggagagaaaaagttgggaaaaaaggcgtagtcagagatgcgaaagtacatcaagaagtcattgagaaagtaatggagtatgcaaaaagtattggatttgcacctcagcaccttgaattttcaccgataaaaggaccggaaggaaatattgagtatctgcttcacattgtaaagacagataccgaaaatccggtaaaagagcaggagctttcaattcagaatgtcgttgctctggctcatgcggagttggataaataatggataaattttttattattgcaaacagacaaaaagataaagaattaaagacggcaagaaaagtcgaagcgtatttaaattccaaaggaaaatcttgcattttaagagaagaaacatcggaacaaaaagccagaagcaatcattatacggatgtggaaaaaatcccaaaggatgtggagtgtattattgtgattggcggagatggaacacttttgcaggctgcaagagatgtggtaaatcgtcagattccgcttttgggaattaatatgggtacgcttggatatcttgctgaaattgaccgttcttctattgatggagcattaaatcatctgatgttagatgaatatacaatagagaaacgaatgatgttaaacggaaaagtttatcataaagaagaactgattgcagaagatgttgcattaaatgatatcgtgattggtagagatggtcctttgcacgtaacgagatttcataactatgtaaatggtgaattcttaaacagctataccgcagatggaatcattatagcaactgcaactggctcgaccggatacagcctgtcagcaggaggaccgattgtatctcctgaaacaaacatcctgattatgacaccggtagcaccgcataccttaaataccagaagtgtgatttttccggcagaagatgagattacggtagaaatcggagagggaagtcagggctgtgaggcaaaggcagtagtaagctttgatggagataccaatgttccgatgcgtacggcagacagagttgcgatacgacgttccgtgaaagacacccagattataaagataagtaatattagttttcttgaagtattaagacggaaaatgaaaaactaaggagacggacagattatgaaaattgccagacattcaaaaatcattgacctgattaaccaatatgatattgaaacccaggaagaactggcagctaaactgcaggaagccggatttgcagtgactcaggcgacagtttcaagagatatcagagagttgaaattgatgaaaatcgcaaaaccggatgggggttctaaatacacagttttagagcagcggacgaatcaggacagcgaaaaatataaaagggttttgcgggatgcactgttatccatggaaatagcgcagaatattctggttataaaaacagttgccggaatggcaaatgctgccggagcagcgcttgataacatgaagatgaatgagattgtgggctgtattgccggggacgatacgatagcctgcattaaccgtacagtagacgatacgattatcttaatggaaaaaattaaaaaaattattaacacaggcgaagagagtacaaggtaaaaaatatgttgttgcatttgcatgtaaaaaatctggcactgattgatgaagcagaagtagattttacagaggggcttaatattctgactggagagaccggtgccggaaagtcaattttaattggttcgattaatctggcacttggtcagaaagcttcaaaaagcatgataagggagcatgcggagtatgcgtttgtggaactggtatttgaagcaggagagcggactgccgaaaaattgaaacagatggatattttcccggatgacggacaggttattatcagcaggaaactgacaggaaacagaagtatctgtaaaataaatggagaaacctgtacggtttctatggtaaaacaggcagcgttttatttgcttgatattcatggacagcatgaacaccagtctttattatatccggaaaagcagatggaaattctggatgcttatggaaaagaagagattcaaaagaaacgagagcaggttcagaaagattatgaaacttataaggcattaagaaaagaacttgaacagtatgagatagacgaagaacaaaaaaaacggcagatggattttctggcatttgaaatttcagaaattgaagatgcaaaattgaaagtgggcgaagatgaagagttagaggcacagtatcgcaaaatgataaatgcaaagcggattacggaaagcctttcagaagtgtatgaactgacagggtatgaaagagaaggaagttcagaacagattggcagagccgtccggcagttatcgcaggtatcggaactggatgatgacttaaaaggaatttatgaaaccctgaacgatatagatgctcttttaagtgactttaacagagagctttcttcttatctttctggtttccaattttcacaggaagagtttttggagacagaagaacgtttaaatcttctgaatcatctaaaatcaaaatatggagcaagtattgaggcagtactggaatataaacaggaaaaagaagaagaatacgaagcactggaacattttgaacagaatcaggcggaattaaaaagaaaaatagaagagcaggaaacggtattacaaaaacagtgtgaatgtttaacaaaaagtcgaaaaaaatgggcaaaaagtctggaaaaagagattatcgaaggactgcaggaactaaatttcctggatgttgcatttgagattgtgtttgaggaaaaagcagagttttcttcaaatggaaaagacagcatctgcttttttatttcgaccaatcctggagaaccgaaaagagaacttcaaaaagtagtttccggtggagagctttcccgaattatgcttgcgattaaaacgattctggcggataaagacgaaaaagaaacacttatttttgatgagattgacacaggaatcagtggaaagacggcatggaaagtttcagaaaaaatggcagtgattgcaaagtctcatcaggtactttgtattacgcatctccctcagattgcagcgcaggcagattctcattttttaattgaaaaaagtgtaaaagagctggaaactcagacaaaaatctggcgtcttgatgaagaaaaatcggtggaagaactggcaagaatgcttggtggagaaagtattactgagacggtactttcaaatgcgcgtgagatgaaagaaatggcacaacaacaaaaaaatacaagagtgaaataatagaattttcacatactaaaaagggtacacaattaacgtgtatccttttttgtatgtgaaaactgcaaaataaaagtttgcatttagaatgaaaaaagaatttatttgaaaaaaataacaaaaggatgtgattttttgaaaaaaaagtgtaattttcgtcgtcttttattcgtattattattagcagatattatctgcgcaggattttttggatggaaaatcaccgaacaggcaattccggatacggtgtatctgtccaagaaagaagaaaaaggaatttctgaattacgaaatctgccatttgtgacttatgaagatacaattcaaacttcgaaggggaatgcatactggatttcctgtaaactgtttgatacgattccggtaaaaaaaataaaagttcagacagtagaggaagataaagtttcggtttgcgggcagccggtaggactttacatggagacgaagggagtattaataattgatacaggagaaattgtacaagcggatggaatgacctgtacaccagcaaaaaatattgcaaaatcaggggattacattcttaaagtaaatggggagacaattcagacgaaaaaggagctgattgataaaatacaaaattcagagggaaaagaagtaacacttttagtagaacgggatgaggaagaaattccaatctgtattcaaccggtaaaagcgcaggatttaaagtataagcttggaatctgggtcagggataatacgcagggaatcggaacgttgacattcttaaccaaagaggggacttatggtgcactggggcatggaatcagtgatacagatacaggagctctgcttaagatttcacagggagaactttatgaggctcaggttgtctctgtagtaaagggaggcagaggaacaccaggtgagttatcgggttatattgattatagtgagggaaaaaaacttggaacaattgaaaaaaatcaagaaaatggtgtatatggaatgattggaatacaggaacaaggaaaactgcccctttgtcagatgagtattggttataagcaggaagtttgtaccggagaggctgaaattttaacaaacgtagagggagaggtaaaagcataccgtgcacagattacagaaatttttccggaacacgcagattcaaataaagcgttttctatcgaggtgacagatgaaacactgcttggcatcacaggtggaatcgtgcagggaatgagtggaagtcccgtgatacagaacggaaagctgataggggctgtgacacatgtatttgttcaggattcaacaaaagggtatgggatttttgctgaaaaaatgctggaataaataaaaagttgtaatttgtcaaaatgtcgaaaaataacagaaaagaatacttattgtagaaacaattttcttgattaactgacagacagagaatataatacaagtaatccttagaaaatggcaattcaacagggcgcccgtcgtttactgaggaaagcagcaataagtgatggaggattagaaatggaaaaattaaatgtcgcaattgcagatgataatgaaaaaatgatagacttattggagacgctcatcaaagaagataatgaattggaattagtcggacacgcaaataatggtgctgatatttatgatattattaaagagaaagaaccggatgttgtacttttagatatcattatgccaaaagtagacgggctgaccgtgatggagcgggttggaaaagattgcacaattaagaaacatccggcatttattgtagtatccgcagtcggacaggaacagattacggaagatgcttttaatcttggcgcaaattattatgtgttaaaaccattcgataatgatatgctgatttcaagaatcaaacatattcgtcagttgagagacggaagaaaagatttaagaagaattaatgcttatgaagataagaacacttattttgaacgcaatcttgagaccgatgtaacaaatatcattcatgaaatcggagttccggcacacatcaaaggatatcagtatttaagagatgccattattctttctgtcaatgatatggaaatgctgaactctatcacgaaaattttatatccgacgattgcaaagaaacatcagactactccaagtcgtgtagaaagagcgattcgtcatgcaattgaagttgcatggagcagaggaaaaatggacaccatcgatgaattatttggatatacagtcagtacaggaaagggtaagccgacaaattcggagtttattgctttaattgcagataaaatccggttagaatataaaaaataactttcaatgccagacaaaaaggagtataatcatcttaaatagacatcgaagcaaggaggaattttttggtgaaaaagattttatttgtggcatcagaagcagtgccttttataaaaacaggaggactggcagatgttgtaggggcattgccaaagtgttttgacaagaacgaatatgatgtgcgggtgattattccgaaatacatgtgtatgaaagaagaatataagaatcagcttcagtatgtaacacatttttatatggatattggttaccgcagagagtatgttggaatcatgcagatggtatatgagggaatccagtattactttatcgataatgaatattatttctcaggatatcagccttacggagatattcgatttgatattgagaaattttcttatttttcaaaagcagccttatccattcttccggttattgacttcagaccggacttgattcactgtcatgattggcagaccggattagtgcctgtattcttaaaagaccgttttcaggatggtccgttctatcagggaatcaaaactgttatgaccatacataacttaaaattccagggaacctgggatattaagacaatccgtgatttaaccggacttccggcatattactttactccggataaactggaatcttataaagatggaaaccttttaaaaggcggtctggtttatgctgatgcaatcacaaccgtaagtaatacttatgccgaagagattaagacagaattttatggtgaaaaactggatgggctgatgagagcacgtgcaaatgacctgcgtggaatcgtaaacggaattgattatggtgaatggaatccagagacagatcagttgattgcaaagaattacaatgcgaaaacatttcgtaaggaaaaagtaaaaaataaaatagaattgcaaagagaacttggtttaaatcaagacccgaaagccatgatgattggtattgtatctcgtctgactgaccagaaaggttttgacctgattgcttatgtgatggatgaattgtgtcaggataatattcagttagtggtacttggtacaggggaagaacagtatgaaaatatgttccgtcactttgcatggaagtatcagggaaaagtatctgcaaacattttctatgataatgcaatgtcccataaaatttatgcttcctgcgatgcattcttaatgccgtctctgtttgagccatgtggtttaagtcagttaatgagccttagatatggaacgattccgattgtaagagaaacgggtggattaaaagataccgtagaaccatacaatgaatatgaaagtaccggaaccggattcagcttcacaaactataatgcacatgaaatgctagcgaccgttcgttatgcagaagctgtttactatgacagaaaacgcgaatggaacaagctgatcgatcgtgcaatggcaaaagatttctcctggggaaattctgcaaaacagtatgaagaaatgtataattggttaatcggttaataaataaatcaattaatagaaaaaaggatatcccttgtcatcttgggatatccttttttaatataaatttacatcagattataagaataatggagtaaatacaacagcaacaattgtcataagtttaatcaggatgttgatagacggtcctgaagtatccttaaatgggtcgccgacagtatcgccaacaacagctgctttatgagccggacttccttttccgccatggtgtccatcttcgatgtatttttttgcattatcccatgcgccaccggagtttgccatgaagattgccattaaaacaccggttacaagagcaccggcaagcagtccgccaagtgcagaagaaccaagaatgattccacataaaagaggagcagcaactgccatcagacctggaagcatcatttcttttaaggcagcctgagtagaaatttccacacaggaagaataatccggtttgccttttccttccatgataccaggaatggttttaaactgacgacgaacttcttcaatcattttgtttgctgctttggaaacagaatccatagtcatagcagagaataaaaatggaagcatacctccaaggaagagtccgatgataacctgtggatttaagatatcaatggattccagtccgacagcctctgaataagaaacgaataaggcaagggcagtcagggcagcagagccgatagcgaatccttttcccatagctgcggttgtatttccgacagagtcaagtttgtctgtaatattacgaacggaatcttctaatccggacatttctgcgataccaccggcattatcagcgattggaccataagcgtcaattgcgattgtgattccggctgtggaaagcataccgactgcggaaagagcaattccgtacagtccacagaaatgataggaacataaaataccaattgcgataaaaaacagtggaagcatagtggaacgcataccaacagaaagaccactgatgattgtggtagcagaaccggtttctgactgggctgcaattctctgaaccggtttataatcgccggaagtataatattctgtcataataccgattaacagtccgacaatcagaccactgatgatagcgagtgctgctttcatatcaccaaagaataccttacttagtacaagtgaaagaactaatacaacggcactggaaccataagttccggcttttaatgcttttcctgggtctgcatttttgctggcttttacaaagaaagtaccggcgatcgatgcaaggattccaaatgcagcaagtgcaagagggaatacggcacccggttctttgaagtagatgacaccaagagtaattgcagatacaagagagccgacataagattcaaaaaggtcagcccccataccggcaacgtcaccgacgttatcaccaacattatcagcgataacagcagggttacgagggtcatcttccggaataccggcttctactttaccaacaaggtcagctccaacatcggcagctttggtgtaaattcctccacctacacgggcaaataaagcgatggaagaagcaccaagcccaaatccggaaatgacgccggtatcttttgtaattaagtagacaatgctgacaccaatcagaccaagtccggtcacgcacattcccataacagaaccaccggaaaatgcgatggataatgctttaggcataccggattcttttgcggctccggcagtgcggacgtttgcttttgtagcaacctgcatgccaaaataaccggcagcagaagagaacagtgcacctaaaagaaaggcgcaggcagtactccagctttttaaagcaaagcctaaaataaagaataaaagtgcaacgaagataatgagaatacggtactctgccattaaaaaggcctgtgcgccttcatgaatgtaagaagcgatttcctgcattctctgatttcctgcatcctgctttttgatgttgtttgagagtgtaaaagcaaaaagcagggcaaggacaccaacgattggtgcgagatagatcatggtttccataagtctcctttcttacttgtgtgatgtaattttctgtaaataataaaaaaatcacacaagatataaaaaaataatatttataggtatattatacggttaattcgtctaaaagacatcaaattaattcatctaaaacgtaaaaaatgacaaaaaaataattaaaaaatcaacttttcttgactttttgtaaaaaatcgaggataataaaaagcaataaatcaaaaataaatcttaagattcttaaattttttatccttagcgttcgctgaaaataatctccaaataatctataaagctgtaagcagaaaaagaaaactcattgacaattaagagaaagtatactattatatcaactatagatacgaacataagttcgctgtatataaaaaatagaataaaggagtaaaaagatggtcaaagaagataaactaaaagcacttgatgtagcgcttggacagattgaaaaacagtttggaaaaggttctgttatgaaattaggtgattccagcgtaaatatgaatgtagaagctgttccaactggctctttaagccttgatattgcattaggtcttggaggagtcccaaaagggagaattattgagatttacggaccagaatcaagtggtaagacaacagtagccctccacatggttgcagaagtacagaaaagaggaggaattgcaggttttatcgatgcagaacatgcgttagaccctgtttatgcaaaaaacattggtgttgatattgataacctttatatttctcagccggacaacggagaacaggcgatggaaattacagaaaccatggtgcgttccggtgcagtggacattgtaattgtagactctgttgcagcacttgttccgaaggcggaaattgaaggtgatatgggagattcccacgttggacttcaggcaaggctgatgtctcaggcacttagaaaactgacagcggttatcagcaaatcaaactgtgtggtaatctttattaaccagcttcgtgaaaaaattggagtgatgtttggaaatccggaaacaacaacaggtggacgtgccttaaagttctattcttccgtgcgtatggatgtcagaaggattgaagcattaaaacaggcaggagagattatcggtaacagaaccagaattaaagttgtaaaaaataaagttgcaccgccgtttaaagaggcagagtttgatattatgtttggaaaaggaatttcaaaagagggtgacgtgcttgatttggctgccggacttggaattattgtaaaaagtggtgcatggtatgcctataaggatgcaaagattggtcagggacgtgaaaatgcaaaacagtacttgagagacaatccggagattcttgaagaagtggaaacacaggttcgtgagcattacggacttccgactgagaagaagcaaacagagtctgcaaaatccgagagtaaaaaaggtgaataatggagataacgaaagtacaggctttgacaaaacagaagtatagaatatttttagatggggaatctgcttttgcggtttataaaggcgaactttcccgttatcatttagaggagggagcagtgcttcctcctgaagtttatgaagaattagtcaacagggtactcaaaaaacgtgcaactttgcgcgctatgcatattttggagcgtacggataaaacagaagcacagcttagaagaaaactggaagaaagtgagtatccaaaagaagcagtggaatctgcgattgcttatgtaacatcttatggatatttagatgacagacgatatgccgaacattatattgagtggaaaaagcagggaaaaggaaaagcgagactgaaaatggaacttgtccagaagggaatttccagagaaattattgaagaggtattagaatcgacagattttggagaaacgagagaaatgattcgtcagattatcttaaagaagcgaaagacagatattcccatgaatgaaaaagagaagcagagactttatggatttttaatgagaaagggattttcttcgtcggatattctggctgttatgcgtgaggaagaatggcggaataatacagaattttaataaaaaagttcgacaaattatacagagagaggtaatttttaaaacgctttttagttgactttttattgaaaacagtataaaattatactgttgtatttgtacaatgaaaattaaatataaggaggtgctcctgtgggaatcattgtgataactgcgattattgctgttatagttaccttagctgtttcagtgccggttactgcaaatctttctgtaaagaaaaagacagaaaaagatgcggaaacaattggaactgctgaagtaaaagcaagaggcattatagatgaagcattgaaaactgcggaaacgaaaaagcgtgaagctcttttagaggcgaaagaagaaaaccttcgcaccaagaatgaattggaaaaagagacaaaagagagacgtgcagaacttcagaaatatgagaagcgtgttgtctccagagaagaagctttggataaaaaagcagatgccatcgaaaagcgagaagcagattattcagcaaaagaagcagagttaaagaaaaaagaaaagaaaatcgacgaattacatgaccagagagtacaggaactggagagaatttccggtcttacctccgaacaagcaaaagattatcttttaaaaactgttgaagacgaagtaaaaactgacactgccaagctttataaggaattagagagtaaggcaaaagaagaagctggtaaaaaagcaaaagaatatgtggtaactgcaattcagaaatgtgcagcagaccatgtagcggaagctacaatttcagtcgtgcagcttccaagtgatgaaatgaaaggacgtatcattggtagagagggacgtaacatcagaacacttgaaaccttaacaggggtagatttgattatcgatgataccccggaagcggtagtcctgtccggatttgacccaatcagacgtgaggtggcacgtattgcattggaaagactgattgtggatggaagaattcatccagccagaattgaagagatggtggaaaaggcacaaaaagaagttgaaaccatgatgagagaggaaggagaatctgctgcacttgaagttggagtgcatggtattcatccggaattaatccgtttgttaggacgtatgaaattccgttccagctacggacagaatgctttaaaacattcaattgaagtagcacagattgctggattattagccggagaagtcggaaccgatatccggatggcaaaacgtgctggtttattacatgacatcggaaaatccatcgaccatgaagtggaaggttcccatattcagatcggtgctgacttatgtagaaaatataaagagtcccagattgtaattaatgcggttgagtcccaccacggtgacgtagagccgaattctctggtggcttgtcttgtacaggcggcagatgcgatttcagctgcaagaccaggtgcaagaagagaaactgtagaaacatataccaacaggttaaaacaattagaagacataacaaactccttcaagggagtagaaaaatcttttgctattcaggcaggtagagaaatccgtgtaatggtacttccggaacatgtaagtgatacggatatggtattgttagcacgagatatttccaaacaaattgaagctgaactggagtatccaggacagattaaagttagtgtaattcgtgaaagccgcgtagtcgattacgcaaaataagaaacagatgcagagtcaaagaaaaaattctttggctctgttttttaaccaaatcaagtaagtcccctgcttcaattgcgaaaagcaataagcaggggacttgcttgtatcaggagggggcaagccccttctgataagctgcgtagcagctatttggttatgagcaagtagcgaagcggattgcgaatatccacttgactttgcaggaaattgcttttctgtaaaaaattttttgtgttaagtataataaataaggcataccttgtatagggggaaaaaatgaaaaaaaggctttctatttttttgattctatattttgtaggctttacaattggaattctttgtacgagtctgttgaaaaaggtgacacaggagaatacagctttacttggtatctatctgaaaaatcaaaatacagaatctgttttaaatgttcaggtatttggtcacttattaaaactgagggggaaatggtttctgttttattttataggtggaatgacgcctgcaggaattgtaatggtattggcaggatgtctgtggctcggacttttagcaggctgtctggttactttatttttgatggagtatggggtcattggaatttttttctgcataggatgtgggattcctcagagtttcttttatcttccctctgttttagctctgttttttttatgcagtgagatgagtcttaaattctggaggaaaagttaccggagaaaagaggactataaggggtacgttttttttatgaccagtgcggcacttatatttttgcttgggatttttttggaaagttatgtgagtcccaatttattaagagtattatttcattaaaaaattcataaaaagttaacaatttaaaatttaccatatatggtggatgaaaaatagtggctgccgatatcttgtataaataaaaaaacataatggaaaacaggaaaaggaaccttaaaaaggggtttgatttttaatccaaaagtgatatataatccatttatagcaaatatattcttgaagtttttgtggttttgacgttgcagaaagactttgagagtgtctagaaagattagagataaaggattgtatcatgaagtgtgagatagaagagtttattgggtatttacataacacaagaggcacttctttcaatacagaaatttcttacgagcgggacttgcgcaaattggagcagtttttgaaggacaaagggatacgcagaataaggcaagtgacagaggcagaattaaacagttatgttacttatttggaacgggaggagtttgcggcttcttctatttccagaagtattgcttcaattcgtgcattttttcaatatttttttaatcagggacttattcccaaaaatccggcagatactttaaaagctccaaaagtagaaaaaaagataccggagattctttctgtagaagaagtggatttgctgcttgcccagccagatgaaaaaacaataaaaggaatacgggacaaggcaatgcttgaactgctgtatgcaacggggatacgtgtcagtgaactgattcatttatccgtcagggatgtgaacctgaaattaaattatatcagctgtagttcaatggaaaagagccgtgcggttccatttggaaatacagcaaaaaaggcagtggagacttatgtggaacaggcaagagatgtacttttaaaagaaaatgacagtcccaatttgtttatcaactgcaatggaacggcaatgagccgtcagggattttggaaaattttaaagtattatgcaaaacttgcaggaattgaaaaagaaattacaccgcatactctgcgtcattcttttgcggtgcatttattgcagaatggtgcagatttaagaagtgtgcaggaaatgctggggcattcagatatttctaccactcagatttatttaagtttgaatacaaatcgaatcaggaatgtctataaaaaagcgcatccaagaagctaaaaaagtgatgtaccaaaaaagaccgtagtcttcttttcagtggaagactacggccttttttattagcagagctctgcgattgtataaagcagtttttcagtttcatcccatccaaggcatgggtctgtaatagattttccatagacatggtttggtccgattttctgatttcccggttcaatataactttcaatcataacgccttttactaactggcggatgtctttagaaacaagacggctgtgaaggacttctttgacgatacgaatctgctgttcatattttttaccggagtttgaatggttggaatcaatgataacagctggatttgccaggtcacgttctccatacatttcaagcagaagctgtaagtcttcgtagtgatagtttggaatggtatttccgtgtttgttgacagcacctcttaagatggtgtgagtcagaggatttccttcagtgctgacttcccagcctctggaaataaaatcatgaccatgctgtgcagcaacaacggaattaagcataacagaaaagtcaccactggtcggatttttcataccaaccggaatgtccagaccgctgaccatcagacgatgttcctgattttcaacagaacgagcgccaattgcaacataagaaagcaagtcagagagataatgccagttatccggataaagcatttcatctgcagaagttaatccggtttctttaatggaacggatatgcatgtgacggattgcaaggataccggcaagtacgtctggttttgcttccgggtcaggctgatgaagcattcctttatatccttctcctgttgtacgaggtttgttggtatagattcttggaactaatacaagacggtcggcaactttttcctgaacttttgcaagacggttggtgtaatcgcagactgcttcttcattatcagcagagcaaggacctacaataaccagaaatttatcagaattgcctgtaatgacatcctgaatcagacggtctcttgtttctttcacttttttcatttcttcggttaccggagacatttctttgatttcttccggagatggaagttgtttcacaaatttaaaactcatcttaactttctcctttatctctgttcattttctgtggatattgtacagaaagtatcctatcaatgtttgattataatacagaaaaaaaggcttgtcgactgtttttgacgattttatgctttaaagttaaaaagaaatattgctttcctttcagatgctctggtaacttagttgcagagtagttcacaagcatttccctttcagaaaaagatgaagaaaaaaaagcgttaaaaatgtagtaataagttcacttaaaagcagtccccagaggtaaccgatgattccgtgggtcggaattacgaaaaaaacaaataaaagccggatagaaagacctgtcatattttgaaaaaagtaaggaccggtctgaccaagtccatttaaaattccacttaaggtacttgaaagatagagacagggacagataaatgataaggtgcggataaaagtggaagcaagttcatttttgaataaaaacagtccgagaaaatctgccagaaaaaagaagctgaatgtgaagagaaaaccaagaatcagacagtaacgaattgttttttgaatacaaagccgaatattatcataatttccaagtgcctggtgttctgcaacggaaggcagcaacatgaccgagactgcatttgtaattgcacagggaaatagaattaagggcagcgccattccatttaagacaccatatacagacagggcagtctgctgagtcattccaaacaagcgcagatgtcccggaattaaaatggattcaatactgtgcagaagattgaccagaaggcggttacaggtaagaggtgtagaaaaagccagaatttcttttaactgccgaaaaggtctgattatcttgcgaacaggctgagtggaggagtgaaaatccatgatggtaataaataaggcgaacagcatggaaataaattccccaaaaaaaagaccaaagacagcaagcataggagtgattgcgtgtccttcctgactccagacaagccagagcagataggaggcggcaacacgggcagtctgttcgattaactgagagagagccggtaaaagtgttttttttcgggcaaaataataaccgtttacgcaggagtgaaacgttcccatcggaatggagagggaggatacttttaaaagagaagtacattgtggttcaaataaaatatgtatagcaaaccagtcagcataatgaaaaagaaaaaaagtgacaagaatagaaagtaaggtagaaaaagatgtggcgattaaaaagacggctcttgcatcggagtcctcttttttggcaaatttggcagcaacaaggcgtgaaattgcagtctggatgccaccgacggtcagagcaaaacaaagagcatgaattggaaaaatcaactgataaattcccattccggtagaaccgattgtctgagagaggaatattctatacaagaaaccgattatttttgtaaggaagccggagagcgttaaaatcagagtccctttgagcatagtacgagtatgattcatggcagatttccaaaaacctttttctcaaatatattcaaaaaaccatcttgacagaacaagataagaatgatattctacttttaaatccgagtggaatagtcggaatttaaaaggatggtggttgtttgaaattatcaaccaaaggaagatacggattaagagccttgatagacctggcattatatagtgaaaatgagactgtttccatacagagtattgccagaagacaaaacatttctgacagttatctggaacagttgatgcgaaagttacgaagtgcaggactgattgtcagcgtcagaggtgcgcagggtggttataaactggcgagaccggcaaacgaaatttctgtgggagatgtcttaagggcactcgagggaagtttagaggccgtaacttgcggaggagaagacaatagttgccagggggcagatttatgtgtaaccaaatttgtgtgggaacggattaacagcagtatccgtgacaccgtagattcaattaagctgagtcagcttgtagaagaaagccgtctgatgcgggaaaaggggcagattcaggtacaaaaatgcgataattaaagtttataggagagataaagctatgaaaacaagtatctatttggacaatgcagcaacaacaaaaacagcacaagaagtagtcgatgcaatgcttccatattttacagaaaattacggaaatccatctagtatttatgatttgggaacaaaaagtaaagaagctatcacaaaaggaagagaacagattgcagaagtgcttggtgcaaaaagtgaagaaatttatttcacagcaggcggaagcgaagcagataactgggcattaaaagcaacatttgaagcttataaaaataaaggaaatcatatcatcacaacaaaaattgaacatcatgcaattcttcatacctgcgaatatctggaaaaacgcggtgcaaaaatcacttatcttgatgtagatgaaaatggtgttgttgatttagaccagcttcagaaagcaatcacaccagaaactattttaatttctgttatgtttgcaaacaatgaaattggaacaatccagccaattaaagaaatcggtatgattgcaaaagagcacaatattttattccacacagatgccgtacaggcatttggacaggttccgattaatgtagacgaattaaatatcgacatgctcagctccagcggtcataaaatcaatggaccaaaaggaattggtttcttatacatcaaaaaaggggtgaaaattcgttcctttgtacatggtggtgcacaggaaagaaagagaagagcaggaacagagaacgttccgggaatcgtaggatatggtgtagcagcaaaacgtgcagcagattctatggaagaacgtacaaaaaaagaaattgaattaagggactattttatcggaagaattttaaatgaaattccgtatgtacgcttaaacggagacccgaagagacgtctgccaaataacattaatgtaagtttccagtttgtagagggtgaatctcttctgattatgcttgatatgaaaggaattgcagcttccagtggttccgcatgtacatctggttctttagacccatctcatgtattgcttgcaattggactgcctcatgaaattgcacacggttctcttcgtatgacaatcagtgatgaaacaacaaaagaagatttggattacaccttagaccagattaaagaaattataagcagactgcgtcagatgtctcctctttacgaagatttcgtaagaaaacatcaggcataagaaaggcacataaaaaagacataagaaaagtttaagattaagataacggtaatagttaaatttgatttaagataaaagaaaaagacaggatataacggaggaataaacgatatgtacagtgaaaaagtaatggaccattttcagaatccaagaaatgtaggtgaaattgaaaacgccagcggagtaggtacagtaggaaatgcaaaatgtggagatatcatgcgtatctaccttgatattgatgatgacggaattatcaaagattgtaaatttaaaacatttggctgtggtgcagcagttgctacaagcagtatggcaactgaaatggtaaaaggaaaaagcattcaggaagcacttcaggtaacaaataaagcagttatggaggcattagacggacttccgccggtaaaagtacattgctctttacttgcagaagaagcaattcatgctgcactttgggattatgctgaaaaacatgatatcaaaatagaaggcttagacaaaccgaagtcagatatctctgagggtgaagaagaggaagattattaatggcaaaaaagaaagttgtcgtgggtatgtctggaggagtagattcttccgtagcagcatatcttttaaaggaacagggatatgatgtcattggtgtcaccatgcagatttggcaggaagaagaccagtttacgcagcaggaaaacggtggctgttgtggattaagtgcggtagatgatgcaagaagagtagcccagatgcttgaaattccgtattatgtcatgaatttcagaaaggaatttcagaaaagtgtcattgactattttgtcaaagattatttagagggacgaactccaaatccatgtattgcatgtaaccgctatgtaaaatgggaatctttactgcaaagaagtatggaaataggtgcagattatattgcaaccggtcattatgcgaaaattgcacagcttgaaaatggacgttatacgattgcagtgtcagatgctgttggaaaagaccagacttatgctttgtataacctgacacagtatcagctttctcatactctgatgccggtaggtgcgtataataaagatgaaattcgccagattgcagagaaaatcggacttcaggttgcacataaaaaagacagtcaggaaatttgttttgtgccggataaagactatgctggctttattgaaagaagcacaaatcggaagataccaaaaggaaactatgtgctggcagatggaacggtaatcggagaacacaaaggaattacgcattatactattggtcagagaaaagggttgaatcttgcgatgggccatccggtatttgtcacaggaatttgtccgaagactaatgaagtcgttattggggaaagtgaagatttattcaaaaaagaattagtctgtcaaaatattaactttatggcaatggaagatttgcctaaaggagaagaaagacgagtgctggcaaaaattcgttacaatcatcagggttccatgtgtaccatcagaagaaccggtgaggatgagattacagcaatttttgatgagccacagcgggcaattacccctggacaggcagttgtattttatgaaaatggctatgtagccggaggcggaacaattatcaacaatacagtaaattagtacagcgtactaaaaaatcgggcagggctgataaaggctctgctcgattttaatttataattatgcaattataatggaaaaaatataggttttcgtttttcaaaaaccgtataataggaaaagccacattgctttaaaatatctactgcacgttcaaattcataagcaatatactgtgggacatgtgcatcagaaccaagagtgataatttccccacccagttcacggtagcgttttaagatttcttcggtcggatttggatgaccaagaccgtatttaaagcctcctgtattacattccagaccgatgtttttatcgacaagaacacggagaatttcgtcaatgatttcctgatagttctgataagaataataaagatttttgtttggaccgtagcgtacaacgtaatctatgtgtccgcaaacatcaaagcaggaatattttttgacattttctaaaagacaggtaaaatatcgtaagtaggcctccttttcactgcggttttcatagaacacagattcgtaagggtcgagccggtctacaacatggacagaaccaatgacaaaatcaaacggataagagtttacaaaatcggaaagctggtttccaagttgaggctgaagtccaagttcaattccaaaacgaatgtgaatctgttcctgatattttttagcgagtgtagaaagtgtctgctgataagcgtccatgtctacgagaaaatcaaactctccaggtgggaaatccaaatcttgatgttctgtaaaacacatagaagaaagtccttttgaaatggctgtttgaatcatttcttccatgggagtgtcgctatcactggagaaagatgagtgtaaatgtgagtccgaatacataaaaaaagccctcctttggttagtttttaacttgatttttgtaaaaaataaaacaaatttacttctattatataggaaaggttggcaaaagtataggaaagatgaaaaactggaataaatattcaaattggacttgaatttttgtccaaaattaggtacaatatgaaacaggttgatgtttctttaacaatctttagaaacttcacgttaaacaaacacttttaggaggaatgaatatcatggcagtaaaagtagcaatcaatggttttggacgtatcggacgtcttgctttcagacagatgtttggagcagaaggatttgaacttgtagcaatcaacgatttaacatccccgaaaatgttagctcacttactgaaatatgactcaacacagggtaaatatgagaaagcagatacagttacagcaggagaagattccatcacagttgacggaaaagaaatcaaaatctatgctaaagcaaacgctgcagaacttccttggggagaaatcggtgtagacgtagttctggaatgtacaggattctatacatctaaagaaaaagcagaagctcacttaaaagctggtgctaagaaagttgttatctctgctcctgcaggaaatgaccttcctacaattgtttacaatgtaaaccatgaaacactgacaaaagatgataacatcatctccgcagcttcttgtacaacaaactgcttagctcctatggcaaaagcattaaatgacctggctccaatcaaaacaggtattatgtgtacaatccacgcttacacaggcgaccagatgactctggatggaccgcagagaaaaggcgacttaagaagaagccgtgctgctgcagttaatatcgtaccaaacagcacaggtgctgcaaaagcaatcggtctggttattccagaactgaacggaaaattaatcggtgctgcacagcgtgttccaaccccaacaggttctacaactatcttaacagcagtagtagaaggaacagtaacagttgaccagattaacgaagctatgaaaaacgcttctacagaatccttcggatacaatacagatgaaatcgtttccagcgatatcgttggtatgagatatggttctctgttcgatgctacacagacaatggttctgcctctggacaacggaacaacacaggtacaggttgtttcatggtatgataacgaaaactcttacacaagccagatggtaagaacaatcaaatacttcggaaaattattagcagaataattttattcgctgaatttaagaagaataaagactcagtcaaggggtccggtcttttgttggaccggactccttttgtcattttatggggaaaatatcctgtaaatttgtccattatttgacatattttatgttaaattcagactacaaatacagtttaagaacggacagaaaataataatttatttaaggaggcatcatttatgctgaataagaaaacagttgatgacatcaacgtaaaaggaaaaaaagtactggtacgctgtgacttcaatgtaccgctgcaggatggaaaaatcacagatgaaaaccgtctggtagcagctcttccaactattaaaaaactgattgcagatggaggaaaaattattctttgttctcatcttggaaagccgaagggagaaccaaaaccagaattatctcttgcaccagttgcagttcgtttaagtgaattactcggacaggaagtaaaatttgcagcagacccggaagttgttggaccaaatgcgaaagcagcagtggaagcaatgaacgacggagatgttattttactggaaaacacacgttatcgtgcagaagaaacaaaaaatggtgatgaatttagtaaagaactcgcatccctgtgcgacgtttttgtaaatgatgcattcggaacagctcatagagcacactgctcaaatgtaggtgttacaaaatatgtagatacagcagttgttggatacttaatggaaaaagaaattgcattccttggaaatgcagtaaacaatccggaaagaccattcgttgcaattcttggtggagcaaaagtatccagtaaaatctctgtaatcaataaccttcttgataaagtagatactttaatcattggtggtggtatgtcttatactttctctaaagcattaggcggacacatcggaacttctctttgtgaagatgattaccttcagtatgcacttgacatgctgaaaaaagcagaagaaaaaggcgtaaaactgcttcttcctgtagataaccgtatcggtgatgcattctctaacgactgcaacatcaaagttgtaaaacgtggagaaatcttagacggatgggaaggcatggatatcggaccggaaacagaaaaactttttgctgaagcagtaaaagatgcaaaaacagttgtatggaacggaccgatgggatgttttgaaatgccaaattttgcacatggtacagaatctgttgcaaaagcattggctgaaacagatgctacaacaatcattggtggcggtgactctgctgccgcagttaacattttaggttatggcgacaaaatgactcatatctccacaggtggtggtgcatctctggaattccttgaaggaaaagaacttccgggcgtagctgctgcaaacgataaataataacattttattaatatctgttagagaaaaaaggagataagaaaaatggcaagaaaaaaaattgttgctggtaactggaaaatgaacatgactccaagtgaagcagtaaaattagtagaaactttaaaaccattagtaaagaatgaagaagtagacgtagtattctgtgtaccggctatcgatatcattccggttgtagaagcagcaaaaggcacaaatattcaggttggtgcagaaaatatgtactttgaagaaaaaggtgcttacacaggagaaatttctccaaatatgctgacagatgcaggcgtaaaatacgttgttttaggtcattctgaaagaagagaatactttgctgaaacaaatgaaacagtaaacaaaaaaatgttaaaagcatttgaacatggaattactccaattatgtgctgtggtgaaactctggaacagagagaacagggcgtaacaatggatttcattcgtcagcaggtaaaagttggatttatgaatgtaacagctgaccaggcaaaagaagcggttatcgcttatgaaccaatctgggcaatcggaacaggtaaaacagctacaacagaacaggctcaggaagtttgtgccggaatccgtgcatgcatcgctgaaatctatgatgaagcaacagcagaagcaatccgtattcagtacggcggttctgtaaatgcaaaaacagcaccggaactgtttgcacaggctgatatcgatggtggtctggtaggcggagcttctttaaaagaagatttcggacagattgttaattacaataaataattagttagaaaaaaataaaggaatccccgtatcttggaaaatatttgaaaagatacggggattttttataacccttccaaattaaatggtggggtatattcttcttttgcactgcttttttcctgcataaaaccatctacaagtccaagtgaaatggcttcttttaaaacagattcatattcataagtagtaattctgcggttcagttccggatattcatgacttttataaaagggtgtatactgacttaaaagactgataagatagcttttgtcaggaagcgcttcttttatccagtgaagcagggtgatagagtcttttcgacagtttggaagtacaagatgccggataattactcctttttgcaacattccgtcggagtcaaagacgggagcgcctgtctgctctatcataagtttgatggcgcatgaggcaatttcaaaatagtcttctgctttagaatattttctggaaagttcagagctgaaatatttcaaatccggaagatagatatcaacataaccttttaaaagccggatggtttctggtttttcgtatccactgctgttatagacaatgggaattttaagctgattttttaccaggtcaagagcatttaaaatagatggaagatattgagtagcagtaaccaggttaatattatgtgcgccctggttttgaagttcaagaaaaatccgggcaagtttttgttcggaaatttctttgccgtaagccgcactgctgatcctataattttggcagaaacaacagcgaagagtacagccggaaaagaaaattgccccactgcctcttgtaccgctgatacagggttcttcccaatgatgaagggcagcacgggcagcctttatctgagaagaggactgacaaaatccaaaagacgaagtccggtcaatgtgacagtttcttgggcaaagtgaacaattttcataaattttagaataattcataatcaaaaattctcctgtaaacttaaggtatcttaatattaatgaaatttctctgaaatttcaagagaagctggaaaaagtctttctttttgtcaatttttggggtaaaatagggtcgattataattataattgagaggactaaaaggggtaaaagagacaaaatggaagaaacacagggaaagaaaaaacataaagtactaaaaagagtgctgattggactggtgattctgattttgcttggtctggcggccgcttatattgcgattggctattattatcaggataagttctatgaaggcacaataataaatggaacagactgcagtaatcagaatgtagcttatataaaagacattgtaaaaaaagaggcggaagtttattctcttacgattaaagaacgtggagatacacaggatatgatagatgcttcagatattcagattacttataaagatgataatgaaattgaaacaatcatgaagcagcaggatgcatggaaatggatttttcgaattggaaaagacaaaaattataccgtgagtcaggaaaactcttatgatgagacgagtcttgagtcttatgtgaatcagatggcatgtatgcaggatgcaaatatgacagctccacaggatgcgtatatgaaagataacggaagttcttatgaaattgttccggaagtagaaggaaatacactggataagacaaagaccttggagactattaaagaagcagtagataaacgtgaaaaagaagtttctctggaggacgcaggctgttatgtagagccggctgttcgtcagaatgatgaaacattgaaaaaagaagtggaacagttaaataagatgacatctgcgcagtatgtgcttgattttggctctggacaggaaacagtcgatagaaataagcttcagtcctggttaaaagaagatgaggcaaatcatacttattcgtttgatgagactgcagttaaacaatatgtcattgatttatcttctaagtataatacggagggaaaagcgagaagttttgtgacaagcggaggtcagacggtaaatttaacgacaggagattatggataccgtttatggcaggataagacgacagagtcgcttttaactgctatgaacagcggagaaagccagaccgtagaagtaacctggttgtataaaggacagacacacgaaggaaatgaaattaacggaacttatgtagagatttccatttctgagcagagaatgtggttctataaaaacggaagcctgattgttgacacaccagtcgtaaccggaaatccaaataccggacatgcaacaccggcaggtggtgtctggaaattaaaagacaaaaaaagtccgtttacattaacggcatacaatccagatggaagtcagcagtatgcagagccggttacttactggatgccatttaacggtggtgttggaattcatgatttaacaaagagaactgcatttggcggggatatctatctgacaaatggttcccatggatgtgtcaacacaccgcttgatgcagtagcgacaatttataataacatagaaattaatacaccgattgtggtttattaataatttattaataaaaagaaagagaacgattttgagctggtcggagtcgttcttttttatcggaattttaaatgttgaaattctgctttaaaactggtataatgcattaggctgaatattaatacatcatgaggtaaaaatcatgaataaataaaagaaggagaaaacaaaatgaagaaaaaattatttgcattagtgttagcttctgttatggcagtttccatgacagcatgtggagaaagtaaatccgcttctgataacagcggttctgcgaaaagcgattccgcaggaagcagtaaaggagtaaaagtaattgatatcgacctgacaaatgaagaatatgcttttggtgtagataaagaccaggaagagcttttaacacaggtcaatgatttcatcggaaaaatcaaagaagatggaacattagatgacatctgtcagaaatactttggcggtggagaaccgacagcagtaaaatcagcacagcttgatacttcaaaagatcagcttgttgttgcaacaaacgcagcatttgagccatttgagtatacaaagggtgaagattactacggaatcgatatggaaatcgcttctatgttagctgatgaattaggacaggaactggtaatccagaacatggattttgatgcagtgtgcctttctgttggacagcacaaatgtgatattgcaatggcaggtctgactgtaaatgaagaaagacaggaatatgtaaacttctcagatacttattatcaggcatctcagcgtctgattgtaaaagcagatgataccacatttgatgactgtaaagaagcagcagatgtagaagcattacttcagaaaactacttcatctgacaagattggtgtacaggcaggaacaaccgcacagtactatattgagggaagcgatgactgggattttgcagggcttccggctgaatgtgtacagtacaaaaatggttctcttgcggtacaggacttagtaaatggaaacctcaaatatgtaattattgatgcggcaccggctgcctgcattacagaagcaattaatgcaatgcagtaaaaaattttcctgtagataataaaaaagaaacaggaagcgaaacagataaactaaaaaagcgggcagaatttcgtccgcttttttctttacaaaaggtgataagatgggaaattttggacagaagattgataaatttattgaaatttttctgcagcagaacggatatgtaaaggtagtacagggacttcaaaatacactcctgattgcaattaccggtttgattattgggattgtaatcggtactttgattgcgactgtgcgtgtgctgcccaaatataaacgtctgccgaaagtattaaatgcaatttgcagtgtatatgttagtctttttcgaggaacacctatggtagtacagctgctggtattttattatgtgcttctgccgattattggggtgcatattaccggtgttcaggtggcaatggttgtatttggattaaacagtggcgcttatatttctgaaattatgagaagtggtattcagtctgttgactccggacagttagaagccggacgcgcagtcggattaagtttcggtgttacaatggtgaaaatagttattcctcaggcggttaaaaatattctgccaacgctgggaaatgaatttatttctttgattaaagagacttctgttgtaagttttgtcggtgcggcagatttatatgtagcatttagttacattggaagcaatagttatgaatttatggtaccttatcttgtaatggctatgatttacattgtattggtgttaattatttcactgttgattaaactgttagaaaggagcctgaatagaagtgatagacgtaattaatctgaaaaaaagctttggtgaaaccgaagtattaaaagatatcagcgtaacgattaataaaggtgatatcgtggttgtcttaggaccttcaggttctggaaaaagtacttttttacgttgtttaaactgtatggaagacccgacaggcggaagcattatctttaatggtgtagatattgctgatataaaagtggatattaatattcatcgccgtcatatgggaatggtattccagcattttaatctgtttaataataaaacagtaattcagaatattatgcttgctccggtctatgtaaaatgtcaggagcttcgtaaaaataaaagaaaaaatatcaaaatccgaatcaaaaatttattttccaaacaaaaagaagaattaattccgattacgacatccaaagcagaaattcaaaaagaagcaaaagagcaggcaatgaatctgttaaagagaattggtctggaggacaaagcagatgtgtatccgtctactttatcaggcggtcagaaacagagagttgcaattgttcgttctcttgcaatgaatccggatgtgattttatttgatgagccgaccagtgcacttgaccctgaaatggttggagaagtattagacctgatgaaggcacttgcaaaagaaggcatgaccatgattattgttactcatgaaatgggatttgcaaaagaagtggcaaaccgtattctgtttatggatgagggatatattttagagagtggttctccgaaagagttttttgaacatccaaagagtgaccgggcaaaagaatttctttcaaaagtactggcataaaagaattcagaaaaaatggatttacccaaaatctgattcgtgctataataagttactgtgagaaattaagacagacaaagcagaaaaagtgatagaaacagaagggagaaattatgagtaaaaaaccaaccgtattaatgattcttgatggatatggactcaatgatagatgtgaggcaaatgcagtatgtgaagccaaaactccgattatggatcagttaatggctcagtgcccgtttgtaaaaggaaatgccagtggtatggcagtaggacttccggaaggtcagatgggaaactcagaagttggacatttaaatatgggcgctggtcgtattgtgtatcaggaactgacaagaattacaaaagaaattcaggatggagatttcttcaaaaatgaagcactgttaaaagcagtaaaaaatgcaaaagaaaataattctgccctgcatttattcggattattatctgatggtggtgtacacagccataacacacatttatatggactgttagagctggcaaaaagagaaggactggaaaaagtatttgtacattgcttcttagacggacgtgacacaccgacaacaggtggaaaagaatatatcaaagaattaaatgacaagatgaaagagcttggtgtcggtcaggttgcgacagtagtaggtcgttactatgcaatggatcgtgataaccgttgggatcgtgtagaaaaagcttacaatgcaatgacaaaaggcgaaggtattttagcagagtgccctgtatgtgcagtaaaagcttcttatgaagcagaaaaaacagatgaatttgtagagccgacggttattgtaaaagatggaaaaccagttggaacggttcaggataaagattctgttatcttctttaacttccgtccggaccgtgcacgtgaaattacaagagcattttgtgatgataactttgaaggatttgcaagagaaaagagactggatttaacttatgtatgctttacagagtatgatgtaacaattccaaataaagaagttgcattccacaaagtttctatcgaaaatacatttggagaattccttgcagcacacaatatgaaacaggcgcgtattgcggaaactgaaaaatatgcgcatgtaacattcttctttaacggtggcgtagaagaaccgaatgaaggagaagatcgtattttggtaaaatctccaaaagtagcaacttatgacttaaaaccggaaatgagcgcttatgaagtatgcgataaactgacttctgcaattcgttctaaggaatacgatgtcattatcatcaactttgcaaatccggatatggttggtcatacaggtgtggaagcagctgcaatcaaagctgtagaagcagtagacgagtgtgttggaaaagcggtagatgcattaaaagaagtagacggacagatgtttatctgtgcagaccacggaaatgcagaacagttaagggattatgagacaggtgaagtatttactgctcatacaacaaatccggttccatttattctggtaaatgcagacccggcttatggattaagagaaggtggctgtctggcagatatcgctccgactctgattgaactgatgggtatggaacagccgaaagaaatgacaggaaaatctctgttaattaaaaaataaaattttagattttgattgttaattcaattataagacctcaggagatggaggaaagtccttctatctcttgaggtctttttcaagtctttatttattgcttgtgaaaaaaagattcctgacagatataaaacttttttagagaatcttctaatttaggagagtatctgcgtttttactgaaaataagtgaaattgcctggaaagtatttagtaaatattccgagttgtttttttaaaacagatatgttattatttcattacacttcagatacagaaaaaatcaagtctgtatgtttaatcctgaccattcggtcaaaaatttcaacttttcaaaaatacaatagtgcatgaatatacagaaaaaggaaagttcgaggattttttacgcttttttctgtgtagctatgcggaaaggggtaattatgtcctggagaaaatgtagaaacaaactgtttgccttaggtctttctgccttgatgtggggaaataccttctcaggagctgtctgggcttctgacttggaaatgcaaaatacaaccgtgcaggagcaggaaaatgtaatggagggagagttacaagaaaaatcagaaatacaagaatcagggtcacaagacacagatgagtcaggaacaaaaatgccggaatcgaagatatcggaatcagaaatattagaaacggaaacttcaaaagagacacaagaatcaaaattaaagcaaaaagaggaagtagaaaaagccggattagaaaaagaagaattaaaagaaaaatttgaacaggacaaattgttagaagaattagaaccggaactggttgactcaggtctctatgaaaaaaatcaagcatttcatttatttagtgcgacaagcagtaaattagaggtgaaatggaatgaatcctttgccagttttgattctggtctgatgagcgccaatgataagatgaacagttcgattaagtatgtggcagctacggataaaaataatccggatttaaagggaaaacaacgtgcggtatactgcctgcagtataataaagatggcccacttggcgatgtgagctggaatggttctggcagaattgcgccaagtcttgcatatcttctatattggggatgtcgttatattggagaacagagtgtctggagtggttatcagaccggatatggctggaaatatgattatatggcaactcagtatgcaattcatatcgtaaacaacgaatattctttaaatacattttatagtcatctcttaaatagttcgaaaaaagaatccttttataaaatagtaaaaaaaatgacagaagatgcaataaatcctgtctattataatccgtttgaagatggatggcagaattttaaatattcgttatccgatacttctgtgacatggagtgcgcagagttataacggaaaagcaggatatatgacaaaatggatttctcagaaattaaatgatggacaggtaaactgcaatgaatatattcagtcacgaaaaattacagtagaccataatgcgacagtcatttggaaagacagtggagattcttctgattttcgactttggattccgttgtctgtttacttggaattacaggcagaaggaggaacgataacagcttctgtaaatggaacgcattccgcatttctttcgggatggaattatttaagtgtcagtaacccggatgattttcaaaaagtaacactgttagaaggtggaggaagaaatgtaggacattcagcaaaagttacagcaacagttccaaaaaaagatgtaaaatgttacattgatcttcaaaaactggataaagaaaccggactggataaaccacagaaaaatgcgagtctgaaaggtgcggtatatgaagtccgaaacgcaaaaaatattgtagcagacaaaatggtaacagatgaaaatggaaaggcaacgagtaaggcactggagatagggacttataccgtaaaagaaattgaggcttcatcagggtatgaactggatacacagacttacacagtaacattttccaatacagatgtaaatcagacaatttaccgtgctgaggtgaaatcacaagaacctgtccatgttccaaaagaagtttccattgaactggaaaaagaaatcttagaaaaagagattaattttgcaaatggagaaccggtgtttttatttgaagtaagagggacgaaagtggatggcacagaatgtgtttatcataaagcggtttcgtttaccagagagtatgtagaaaagaataaaaactctgatgggacaattcgtgcaaaagtgacgtttgaacatctaatggaaggaatttatacggcaaaagagataaaagtgatgcggtatgtcttaaaagacatcaaagaaatttcaggtggtgtcagaaaaggagagacggtcgtatttgatttaaagcaaaatgaaaaaggaagtgccgtatttgtaaacgagaaaaaggaatggcaggactggtctgatgacagttattgtgaaaatgtgattccggggaaagcaggtgatgcaaaatgagaatcaaaatgaaaaaaagaacaggtagaaaagagaaaatatacaagaaatacagccttttgtggattagtgtaattgctttagttgtattggatatcagtgttgcttctgtttcagcttattttagtgacagagaagaaaagaggaatcgaataacggtaggagacagtaatattgaaattgttgaagaatttgaccctcctgaaaaaatcgaaccaggaagtcattttataaaaaaagtctgtatgaaaaatctgggaaaatcggactgttttatccgatgccgtctggaattaagttcagaagagattcttccgtaccttgaatttgatatagataaagcaaagtggagtcttgaggaagatggatattattattatcgggaagcagtagaagtgaaaaaacagaccacaaatctgctggaagagattcagataaaagaaaatgctccatcagaagtgacagagaaaggattttctgttttagtttatgcagagtcctatcagcagggcaattttgaaaaaaatcaatggaaagaagcttgggaacattttgaaagaaatcagcatgcaaaggttttaaagatggacaatcaaacagtaactgcgtctgcttcaggtaagacaattcagaatacagaacaaaaagcagtatcaaagctttctaaagcagatggtgaagtagatattgagttaaaagagtatacgttggatgaaaaaggaaaagaaacagcgtggaaaaatctgtcagatacacttccggggcagaaaattgtaaaaatcccaagagtaaccaatgtggcgtcggagtgtgaaattcgggtaaaaatagaaatggtaatgggagaagaagtagaaattccgattacagttgatttgcttgaaggaatgtccaaagattggagttatgataagacagatggatattattattatagaaaaaaactgaaaaaaggagaatctgtggatatatttcaaggattcagaattccaccagtatgggatacaaggtatacagaaaataaagcaattaaaaaatattatacggaaaacacagtagatgtggtagtaaccgtagaagcaattggagaagaacagcaagaacaggaagagaaatggcagggagaaaaaacagttgtaagttctgtgaatgccccaaaaacctcggatgagacaaaaaagatgccattttttttcgcaatagcttcggcagcaggagtcatacttatctatttctctttaaaaaaggacaaaaacaatgagacaaagatttgaaaaaatgctttatttatcaggtagtattctattccaaattcttttgataggtcttgttatcaatctggcaggctgtgtcgcagggattaaaccggtggctgtaaaaagtggttctatggaaccggcagtcaaaacaggcagtatctgctgggtaaattttaaggcggataaatcaaaacttggaacaggagatatagttgcatttgaacggggagacggacaactggtattacatcgaatcgttcaatgcaccaaaaaaggattcattacgaaaggagatgcaaatgaaacacaagacataggagtggtcagatgggatcaaattaaaggaaaacaactctttggactgccatatattggttttttatttctaagaacagaaaaacagatggcggtttcacttctcatcggcagtttgatactgtttagtctatttgtaattcaaaatcaattcaaaagacgaatctgaaaaacaaatctaaaaaacaaatcaaaagaaattcaaagaaatacaagtcaaattttaaaatcactaaaattaaaaaatttataatatctaaaaaggagaacagattatgagaaaaagtaaaaaaatgacagcaggaattttaggtgcattaacactggttatggtaacaggaagtgcaatggcgtactttacagacagcgagcaggcaaaaaatcatattacaatcggtaaagtagacatttcgctgacagagccaaactgggataaagttccagataaagagaaagaaaatattgttccgggaaaagaattggtaaaagacccaaccattacaaatactgggattaatgatgcatttgtatttatgaaagtgactgtgccggcagcggaattagttactgcaaatgaagatggaacaaaaaatgaaaaagcattaaagcagttatattcctgggagattaacaaaggatggattcagttaggggatgcaaaagcagtaacagaaaatggaaagacaactgcatttgaatatatttatgcttatggaagtaacgcatcttgtagtgcacttgcaaagaacgtatccacatctgctctttttgataaaattacatttttaaatgtaattgagggacaacaatttgcagatggaacaggattggaagaatcggaaactgaaatcaatgtgcaggcatatgcaattcagacaactgatttaacttcaaatgatgtgacaacaccttccgcagtatggcaggtactggcaaatcagaatcagctgtcttaattcatacatggaacgtagataagcattccctcgcttcaagcttgcatataagaaaattatttgacatcaatatagcagttattcgattatgagcaagtagtgaagcggattgcgaatatccgcttgacttatactgcactggaaatttgactttgacttaaattagcatagttttaagaaatcaagagaatactaactgtgaaggaatgtaaaaatacaggaggtattcaaatgaatcgatacttgccaatacgaagagtatatgcacgagaagttttggactccagaggaaatccgaccgttgagacggaaatcacggtgggagaaggaatcataggaagagatggtatcacaggcagagcgattgttccgtccggagcatcgacgggaaaatttgaagcggttgaactgcgtgataaagaaaatcgttattggggtcttggggtacaaaaagcggttaatcatatcaatagggtgctggcagaagaaatcttaggggagaatgcattgaatcaatgcagaatcgataggattctaaaagaagcagatgcaacagaaaataaatccaatatgggtgcaaatgcacttttaggaatttcccttgctgtggcgaaagcagcagcaaaagcaatgaagctgccgctttatcagtatcttggcggaacttatacgacacagatgccggtaccgatgatgaatgtattaaatggaggaagacatgcggataatacggtagactttcaggaatttatgattatgccgaccggagctgaaactttcaaagagggacttcgtatgtgtgcagaagtgtatcagaagttaaaacaacaactaaaagtaagaggattatcaaccggagttggagatgaaggaggatttgcaccgaatctggcgaatacaaaggatatctttttgattttaaacgagtctgttgaacaaagtgggtatcagattgggaaagacatctgttatgcaatggatgcagcagcgagtgaattgtatgattcgaagcgaaaacagtattattttcccggagaatctaaggcgatgcaaaaagaaatctatcggacaacagatgagatgaccgcttattataaagaattaacgaaagaatttccaattgtatcaattgaagatgctttggatgaagaggactggcagggctggaagatgttaacggatgaacttggaaagaatattcagcttgtcggtgatgatttatttgtaacaaattcggaacgtttaaaaaagggaattgaattaaattctgcaaatgcaatcttgattaaagtaaatcagataggaacgttaactgaagcaatggatgcagttcagactgcgcaaaaagctgggtatcgtgccgtgatttctcatcgttctggtgaaagtgaagatacatttattgcagatttggcagttgcctgcagtgcaggacagattaaagccggagcaccctgcagagcagaacgaacagcaaaatataaccgattactgcaaatcgaagatgaattgaaacaagaagccagataccgaaatccatttgcggaggaatccctaaaaaagagttgaaatctccgaaatactatgttaaactgaatatgtttagcgattaggaggtgtacgcatggagattttgagaatagttttaacggttttattcgttattgattgtataggattgactgtgattattctgatgcaggaaggcaaatctcagggccttggaacaattgcaggcatggcagatacctattggggaagaaataagggacgttctatggaaggcgctcttgtaaaagcaaccaaaattatgggaattctgttttttgtattagctttagttttgaatctgaacttttaaaaatgacactcttgcagtcatgcaggggtgtcatatttttatcttataagaaattgtgtcctatgaaataaaaaaagttccgcggggttcgtactgcggtgaatgggaaaagtgttgcttagtaaaccgatgcaggcggagaagcaagagaggagcgaattttgaagaaaaattataatttgaagaaaagaaaaaaaatgctttatgatgtaatgtgctgtaaagaatatactccgatgagggcaaaagatatggcagttttacttcagataccggcaggaaagcgagaagaacttcataaaacgctggatgctttattagaagaaggaaaaattacggttaataaacgggggcgttatgaagctgtaagagaagaaaagagaaaagatgcaaagaaatcgggtaaaaaagagcgaatagaagaaaagagagagaaaaaagaaaagcggggaaaaaataaacgagaagaagcgtatctgacaggaacatttatcagtaatcccaaagggtttggttttgttgagatagaagatgaggaaacggatatctatattccggaagaaaatacctgtggtgcattttataaagatctcgttcagatacagattgtaaaagaagaacgggaaggtcacagacgagagggaaaagttgtaaaaattctggagcatactgtgacaagtgtagttggaacagtcgaaaaaagtgacagctttggatttttaattccggacaaccgtaaaattacaaaagatatttttattccgattgaatgtatgaaaaatgcggtaactggtgacaaagcaattgcgcagataaaaaaatatggaagcagcaaacgaaatccagagggaaaaatcatcgaaattttgggacatgaaggtgaaaaaggggtagatgtcctatctgttgcaaaaagttatgaacttccgatggaatttccggaaaaagttatgaaccaggcagaaaaaattaaaacggaattaaatgaaggtgacttttttggaagaatggatttacgtgactggaccatggtgacaatcgacggagaagatgcaaaggatctggacgatgcggtatctttgacaaaagaaggagaattctatcgtcttggtgttcatattgcggatgtcagtaattatgtgcagtataatagcgcacttgaccgtgaagctttaaaaagaggaacgagtgtgtatctggtagaccgtgtaattccaatgcttccaaagaaactttccaatggaatttgttctttaaatgccggtgaagacagactggctttaagctgtctgatggatattgacaaaaagggaaatgtggtaggacataaaattgcagagacggtcattcatgtaaccgagagaatgacctatacaaatgtcaataaaattctgacgcatgcagacgaagcagtaacaaagaagtatcaggaattagttccaatgttctttttaatgaaagagttatccgaaattgttcgtaaaaaccgcaaaaaaagaggtgcaattgatttcgactttccggaaagtaaagtgattttggatgaaaatggaaaacctgtcgatatttatgagtatgaacataattcagcaacggatttgattgaggattttatgttgcttgcgaatgaaacagtggcagaggaatattattttaatgaaattccgtttgtttatcgtacgcatgaagaaccggattcagaaaaaattgagagtgtattttccatgattcgtgccggaaaaattaaagtaaagaaggcaaaagagaatgtaagcccaaaagaaattcagcaggtattaaaagaaatagaaggactcgaatgtgaaccattttttgcgagattgttactgcgttcaatgaaacaggcgaaatacacgacggactgtattgggcactttggacttgcagcaagatattactgccactttacttctccaatccgaagatatccggatttacagattcatagaattattaaagaaaatttaagaagccggatgacaaaggagaaaaaacagcattataaggaaattcttccggacgtggcaagtcgttccagtatgcttgagagaagagcagaagaagtagaacgtgaaactgtcaaaatgaagaaagcggaatatatgatggcacatattggagaagaatttgaaggaattatttccggtgtgacagaatggggcttttatgtggaactgtcaaatacgatagaaggactggtgcatgtcaatctgcttacggatgattattatgaatatgacagagaacattatactttgacaggagaggatacaggaaaggtctataaaatgggacagaaaatccgggttaaggtgttaagagcagaccttgcaacaagaacggtagattttctcccagcaaaagagaaaacagcagttttctcttatctggacgaagaataaaaagagtagaaagaaggaaagaaaaatggcaaaagaatcagggagtcgtctgattgcaaataataaaaaggcgtatcacgattattttattgaagatacctatgaagcaggaattgagcttgcaggaacagaggtaaaatccatgcgtatgggaaaatgcagtatcaaagaatcctttattcagattgaacatggtgaagtatttgtatatgggatgcatatcagcccttatgagaagggaaacatatttaataaagacccgcttcgtacaagaaagcttttgcttcatcagtatgaaataagaaaaattgcagcaaaaattgcagaaaaaggatttaccttagttccattaaaagtttattttaaaggaagtctggtaaaagtagagattggaattgcaaaaggtaaaaagttatatgataaacgtcagaccattgcaaagaatgaccagagaagagaagcggaaagagaatttaaagtaaagaatttatactaaagaatttatctaaaaagttctgagagtacatgaaatggaggacgaacatgaagttttgtgacatgccatatcagagaattgattttgctgaggcaaaaaaagaattaaatgctttgatggaagagtttaaacaggcagaagatgcagaagcacagtttgaagttcataaaaagtattataaactaaccgataaggtatcaacgcagattacgctggcatcaatccgtcataccttagatacaacagacgaattttatgaaaaagaacaggcatattatgatgaaaaagttccggagtacagcaatcttttaatcgaatatcaaaaacagctgtatcattctccttatcgtaaggaactggaaaaaaagattggtccggttgcatttaaaaatatggaactggcatttgaatcggtcaatgaaacagttattcccctgatgcaggaagaaaacgcactgacaactgaatatgagaaactgcttgcgagtgccaaaattgaatggaatggagaaattttaaatctttctctgctgggtccgtacttaaaaagcaaagacccgaaagtgcgaagagaggcatgcgaaaaacagaacgagttttacttaagtattgcagataaattggatgaaatctatgataagctggtaaaaaatcgtaccgagcaggcaaaacttcttggatttgatacctatacggagctggcttatcgacggatgcaaagaaacagttatggacaggagcaggtagaagctctgcgcagacaggtgaaagaatactgggttccattttcagaaagcctgtatgaaaaaagaaaaagacgtctgaatttggagcacttgtatttttcagatgaacaggtttatggactggaaggaaatccacagccgtcaggcagtccggaggagatactggcacagggacaaaaaatgtattgtgaactttcagaggaaacaaaagaattttttgattttatgatgaaaaatcagctgttggatgttttcggaagaaaatcgaaggcagttggtggctatatgacttatctgccagattatcatgccccgtttgtgtttgcaaactttaacggaacaagtggagatgtggatgttatcacacatgaatgtggacatgcctttcagggatatctttctgcaaaagacccaattcgggagcatgcagatatcggaatggaaaccgcagagatccattcgatgtcgatggaattttttactgagccttggtatgggctgttttttgaagggaaaactgcggatgactacaaagaaatgcacttagaagatgcagcattatttatcccttatggctgtatggtagatgaatttcagcatcgtatttatgacaatccggaattaactccagatgaacgaaaagcagtgtggaaagaattagaacagatttataagccacatcaggattatggagcgcttgcattttatgcaaaaggatgctattggcagagacagcatcatatttacagttatccattttactacatcgattatgtgattgcacagctttgcgcatttgaatataaaaataaaatggatgaagattataaagaagcatggcagagctatttaaaattatgtcgtctgtctgcatctgattattttgaaaatctgttaaaagcagcaggaatccgctctccgtttgaagaggggtgcatgaaggagattgtagataaactcaaaaagaaaattaattagaaaaaagacaaaataaagaataaaaaagaatctcgtttgagggattcttcgataaattcagaaaggagggcagggtgagctgtttcggttcaccctgcgtttatgaaaaaaactaaaaaagttaatagtaacagtcgttgttaaggtggttttgtttttctttgttgattctaatataaaccaaagatgtgaagaaactgtggttaaaatttgaaaaaactgtaaataatctaaaaaattaaaataaaaatagaaaatgaaaaaaaacttgacaaaggctgtaaaaacaggtattgtatactttgtatcaatactttcggatagaaagaccagtaacgggcttgtactggtttcgacgggggttttgaagttgaggaagccatccgcagactccgggactgcgtaccaacctggaaactaaatataaacgcagataataatttagcgttagctgcctaagtgcagcttgtcagccttaagtcacctgctgcttaagaatctggcatcgaacttgcagggcactttgctttcaaagctttgagaaagtagaagaatttatgaagctactaaatgcagcagcctgttgctcggcggttgcaggagggaatgtcaaaagaacaactgtgatgggagatgccgcaagggatagactttcggacgcgggttcgattcccgccaggtccatctgactagaagaagtcgaatttaaaaaggaatgaagaagtgtcaaagatgctttttcattccttttttgtttctcagtctatagaacaaaatggttcataagtttttaaacaagaaggaaaaaattcacaaaaatatcatagatagctgttataatgaagtaagtgttaaaagtataattgcgtttgtgcttgcacaaaaacggcaggaaagaggagtaattatggataaaggcaaaattttagtagtagatgatgaaagcagaatgagaaagctggttcgtgactttttggtaaaacagaattttgaagtattagaggctggagatggagaggaagccctggatattttttataaaacaaaagatatttctttattgatattagatgtgatgatgccaaagctggatggatggggggtctgcagagagattcgtaaagaatccaaagttccgattatcatgttgactgcaagaggggatgaaagggatgaactgcttggatttgagcttggagtagacgaatacatttcaaaaccgtttagcccgaagattctggtagcacgtgtggaggcaattttaagaagaaccaatgtcggagcgaccgatgtattggaagcaggtggaattgaagtcaataaatcggctcatattgcgacgattgatggaaaaccaatggaattgagttataaagagtttgaacttttgacttattttttggaaaatcagggaattgcactttccagagaaaaaattttaaattcggtatggaattatgattattttggagatgcaagaaccatcgatacgcatgtaaaaaaactgcgtagtaaaatgggagagaaaggagagtatattaaaacaatatggggaatgggatacaagttcgaggtttaggaattaaaaaatcaattaaagcccgtctgattgttacatttgtagggattgttgtaattgcatttgtgttgatagctctctcaaacagctttcttttagaacggtattatgtagcaaaaaagacggatgccattcaggatgtctatgaaaagttaaatcaatatgacagtctgaccggtgataaagtgcagagcttaaaaagtatctgcattgaaaaaaatatctcatgggttatcttagatacgaatcattcggaaattctggattacgacagcagaaatgcaaaccgtttatatgcgagtttatttggatacattacgggagttgcacctgcaaaaagttcgactttagaagaaaccgataattatacgctggaagtgaatcgtgacatggatatggattatcttgatatgtggggaatgcttgacaataataatgtgttcttgattcgcctgccgatggcgggaattagtgacagtatccagatttccaatatgttttatctttatacaggtatgattgttgtggcaattagtattcttgctatctggtttttaagccaacgtctgacaaaaccgcttgaagagctgacagatatttccattcggatgagtaatcttgatttcaatgtaaaatatgaaagtggtggagaagacgaaatcggtgttttgggacagaattttaataaaatgtcaaaagaactggaacagacgatttcagaactgaaaactgcaaataatgaactgcaaaaagacattgaaaaaaaagagcggattgatgatatgagaaaagaatttctttcaaatgtatcgcatgagttaaagacgccgattgctttaattcagggatatgcagaaggcttaaaagaatgtatcaatgatgaagcagaaagcagggatttttattgtgaagtcattattgatgaagctgcaaaaatgaacaatatggtaaagaaacttcttactttaaatcaattagagtttggaaacgaccagatttcaatggaatgttttgatttgaccgaattggtacgtggtgtggtaaattccgcacagcttcttgcagaccagaaagatgcacagattttgtttgttcaggatacttcggtttatgtatggggagatgaatttaaaatcgaagaagttgtgacaaattatgtctccaatgcaattaatcatatcgatggagagcggaaaattgagattaaaatgcaaaggagagaaggacatatccgactgtctgtatttaataccggaaaaccaattccggaggaagacattgataaaatctggattaagttctataaagttgataaggcgagaacaagagaatatggtggcagtggaattggcttatctattgtaaaagcgattatggaaagtatgaaccagaaatttggtgtgaaaaattatgaaaatggggtagaattctggtttgaacttgaatgcagataagcattcccccgcttcaagtgtgcggggcactaagcggcgggtgagggggatgcttctgtcagtgggagttgaaagctcccactgacagatcgcgaagcgactgcgttcatgagcaagtagcgaagcggattgcaaatgtccgctttactgcagatgagcattcatccgcttcaagtgcgcaaatgtctgctttacttgcagtcacagaatagagaaaattaaaaaaggaaatcagacaatgtaaaagtgtggttggatgagaattaagaatcgggcagaacaacaatctgtccgcttcttgctttttaatactgattctgctaaactgaatgatgccagaataaaaagagcaaacgctatttgtacttcaatatactttagatacaataagatgtttggctttggtaataaatataagaaaatatgcaaaggaggaatgactatgccgccattacaggggcagtggtatgaggctttaaagccggaatttggaaaagaatactatcgaaagttatttacaacaataggacaggaatataaaacatataaggtttttcctgcaccggatgatatttttaatgcatttcattttactccgcttgatagagtaaaagttgttattttagggcaggatccatatcataatgacggacaggcacatggattatgtttttccgtaaaaccggaggtagaagttccaccatcattggtaaatatctatcaggagctacatgatgattgtggatgttatattccgaataatggatatctggagaaatgggcgaagcagggagtgttaatgctcaataccgtgcttacggttcgtgcgcatcaggcaaattctcataagggaatcggctgggaagaatttacggatgcagcaattcgtattttaaataagatagaccgcccgatggtgtttttactttggggacgtccggcgcagatgaaaaaaagtatgttgaataatccaaaacacttgattttagaagctcctcatccaagtccattatctgcatacagaggattttttggatgtcatcatttcagtcagacaaatgaatttttaattcagcatggaattgaaccgattgactggcagatagaaaatagatagaaaacagatagaggacacaagaaagatgagtaaaaaagaaaataataataccctggtaaaaaatgcaacgtttctgatggttgctgctttgatttccaaaattataggtatgctttataagagtccgctgactacgttaattggacgagaaagttttgcctgttttcagtttgcacagaatgcgtattttattttgttgatgattgcttcctttagtattccgcaggcagtatcgaaaatcatgtcagagagaattgcatttaaacgttacagggatgctcagagagtttttaaaggagcactcttatatgctgtaatagcaggtggaattgcggcacttgtttgtattttcggtgcgtctattttagtaccggataatatggcaaatgcgagactggcgcttcagatgttagcaccaacgatttttgtatctggtatcttaggtgtgtttcgtggatatttccaggcatatcgaaatatgcttccaacttcgatttcacagattttagagcagattgcagtggcgacagtagctcttttagcttctggatttatggtgcgccactttgctaatgcaggagaagatactctgcaaagatggagtgcagcaggtgctacaatgggaacaggagccggcgtctgcaccgcctttttatttatgctttttgtctatagagtgaatcataagacgattgcaaagaaaataaaaaatgacagagtatcggtaaatgaaagctatcgcttcattatgaaaataattttgctgattgcagctccgattatcttaagcgcatttatttataacgtaaacggttatattaatggagtgatgtatacttcgattcttggctggaaaggtgttccaaacagtctggtaaaacagaattatgcagagtatggcttctttatgacattgattaatattccgctgactcttgcaagtaccgcaccgacttccatgatgcctgaagtatctgcacagtatgcgattggtgatttagaagaaacaaaaagaaagattgaccaggcaacatggattgcgatgctgatttcgattccggcgtctgtgggacttgccgtgcttgcacagccggttacacgcctgattttcccatccacagagggagttgcaggacagctgatggtgattggcgttattacggttatcttaaacagtacttcaaatatttcaaatggtgtgcttcaggcaatcggaaaagccaatattcctatgattaatgcagcaatttcgctgggagtcgatattgttttccttgctctggtgttagtatttaccaatatgggaatctatgcagtcgtacttgcgatggtggtatatgcactggttatgtgtgtcttaaatgatcgtgcattaaagaaatacttaggatataaaaatccgtggagatctgcctattttgttccaatcttagcatcgattccaatggggattgttgcagttgctgtatataaactggtgtatgcagtgatcggttcgaattttatttccctgattccatcgattgtacttgcaattgttgtttattttgtgggatatttagtggttgcaaaaccgaaaaaagaagatttggcagcacttccgggaggaacaagactggcacaggttgcacagaaattaaagattttaaaataaaccaaaaagaccatttcatccattcaattttggatgagatggtcttttttagttcagctaagaattagttgtttgtttcatcaagtcgtttaaatgcagtagaaagcattaatttaattcgatttaattggtttacttcacttgcacctgggtcatagtcgattgccacgatgtttgcctttggatattcttttcggatggctttaataacaccttttcctacgatatggtttggcaggcaggcaaatggctggatgcagacaatatttggagcatcggagtgaatcagctccatcatttctccggttaagaaccagccttcaccggtttgatttcccatagaaacaattggtgcagccatttttgccaaatcttcgattttggcagatggtgtaaagtgacggctcttttcaaattctttattggcagtaccgcggataaattcaagggctttgattccaaggtttgctgcatttgcagtagattttttgaatccaagtttttctgctttaaaattctggttatagaagcagtagttcatgaagtccagtaaatccgggcatacggcctctgcaccttctttttcaagcagctctgccagatagttgtttgcagccggaaggaatttgacaaggatttctccgacgatgccaacacgtggtttcttttcgtttgtgattggcagggtgtcaaattctcgtatcatctggcggcagatacggttaaattgtgcgaaacctgcatgttttccggaaacaaattccatacaacggcgttcccatttgcggtgcagggcatttgcagagccttttacggattcataaggacgcatccggtaaagacatttcataaggacatcaccaaatactgcaccgtaagcgagacgggttgcaagttttggtgtaatcttaaatccgggattggcttcgagtccgcttaagttaatagagataaccggaataaatcctaaatctgctttctttaaagcacggcggataaatccaatatagttggaagcacgacatccgccaccggtctgtgacatgataattgccactttatgtacatcatattttccggaaagcagagcctgcataatctgaccgactaccattaaggatggatagcaggcatcgttatttacatattttaagccaacatcaacggcttctttgttatcatttggaagtacctctaaatgatagccacaggagttaaaagcagattccagaatagaaaaatgaatcggtgacatctgaggacacagaatcgtataatcttttctcatttcctgagtaaacggaactttcttgatggaggatggtacaattttgcgggtagcgttttgtttttctttaatgcgcagggctgcgattaaggaacgaatacggattctggcagcacctaagttattgacctcatcaatttttaagcaggtataagtttttccactgtttgaaagaatttcattgacttcatcggttgtaactgcgtcgagtccacatccaaaagagttcagctgaattaaatccagattgtctttttcttttacaaagtttgcagcagcataaagacgggtgtgatacatccactggtcattgacacgaagcggacgttcaatcggtgctaaatgagaaatcgaatcttctgtcaaaactgcaattccgtaagtgttaatcaaatccggaataccatgatggatttcagggtcaatatggtacggacgtccggcgagtacaattccacgacgaccggttttttccagataatctaaagtttcttccccttttctgcggatgtcttcccgacagtgtgccatttcaacccatgcaaggtgagctgcattttgcacttctgaagccggaatatccgaaaattcttcgataaggcgtttcgttacggtttcctcgttggttagggcaagaaatggattatgaaaacgaatatttggattgtccagttcatcaatattatttttaatattttcggcgtaagaagtgacaattggacagttataatgattaatggaatcttcaaattccgtacgttcataaggaacgcaaggatagaagatgtaattgacgttttgtttaatcagccaggaaacatgtccatgtgccagctttgcaggataacattccgattcacttgggatggattcaattccaagctcgtaaatctttctggtagaggttggagaaaggacaacctgatactttaattgtgtaaagaaggtataccagaatggatagttttcaaacatatttaaaacacgaggaattccgacttttcctctgactgccttatcttcggtaagcggttcataagaaaagagctttttgtatttgtattcataaagatttgggattctttctttatttttctcttttccaatcccacgttcacaacggtttcctgagataaactgacgacctcctgagaatttattgatagtcagacggcagttattggtacagcctttacagtttgccattgtggttgtgtattttaattcattgattttatcaatggataacatggtcgtttcagtaccggcactataacgttctcttgcaatcaaggcagcaccgaacgctcccatgataccggcaatgtccggacggatagcttcacagttggcaattttttcaaaacttctaaggactgcgtcattataaaaagtaccaccctgtacgacgatgtggcgtccaagttcagaagcatcggaaactttgattactttgtacagggcatttttgataacggaataggcaagaccggcagagatatcggaaacttctgcaccttctttttgagcctgttttacttttgagttcataaatacggtacatcttgtaccgaggtcaatcgggtttttcgcaaataatgcagctttggcgaaatcctgtacactgtaatttaaggaatttgcaaaagtttcgatgaaagaaccacagccggaggagcaggcttcattaagctgtacactgtcaacggtctgattcttgattttgatacatttcatatcctgaccgccgatgtctaagatacagtctacttccgggtcaaagaaggcagctgcatagtaatgagaaacggtttccacttcaccttcatctaacattaaggcagctttgattaaagcttcgccatatccggtagaacaggaataagcaatttttgcaccctgtggcagttctttataaatctgctgaatggcacggatacttgtagcaagcggatttccgttgttattgctgtaaaaagagaacagtaaagaaccgtcttcaccgacaagggctgctttggttgtagtagaaccggcatcaattccaaggaaacagttccctttataagaggctaagtctcctgtttttacggtatactgactctgacgcgtgttaaatgcatcatagtcttcttttgaagcaaaaagcggttccatacgattgacttcaaattccattttaatgttggcagaaagacggtctctcatctcggtaatagaaacatcggatgcatcttctttggcgtttaaagcagaaccgatagctgcaaataagtgagaattttccggaacaatggtatgttcttcatcaagttttaaggtacggataaaggcttcttttaattcagaaagaaagtgaagcggacctccaaggaaggcaacatgtccacgaattggttttccacaggcaagaccactgatggtctgattgacaactgcctgaaagatagaagcggacaggtcttcttttgtggctccttcattgattaacggctgaatatcagtcttggcaaatacaccgcaacgggctgcaatcggataaagtgctttgtaatgttttgcatattcatttaagccaggagcatccgtttgaagaagagatgccatctggtcgatgaaagaaccggtaccaccggcacagattccgttcatacgctgttctacatttccgccttcaaaataaataatttttgcatcttccccaccaagttcgattgcaacgtcggtaagcggagcacgttcctgaagggaagtagaaactgcgataacttcctgtacaaatggaacttctaagtgattggcaagggtaagtcctccggaaccggtaataaccggatggacagaaattgcacccagtttctgataggctttatctaaaagagaggccagtgtattttgaatatctgcaaaatgacgttcataatcagagaagagcagttcatttttctgacccaaaatggcaatttttacagttgtagaaccgatgtcgattccaagtggatagacgaacggtttggtatcttgtaatgttggcataaagaaacctccttaatttgagtaaataccaatgtaaaaaaatgggacggcaaaaagccgccgttaatgagttatttcctatttattataaaaaaagaaaaaaatatcgtaacaaatccaaaaaaattcagacaggttacaaatcaaagtacattatacgacaagatagataaaaaaacaattggaaatttgtctgacttatgatagaatatttccgtatctattgttgtatttagagacaggtttgaagaaaataatagagtacaagaccaaaaatacaggaaatttttcaattagagagaggaagtttttatgtataaaattttaaaaaaagatgggatggcaaaacgtgctcacatggaaacggtgcatggaagcattgaaacaccggtgtttatgaatgtaggtacggtagctgcaattaaaggtgcagtttcaacaaccgatttgcatgaaataaaaacacaggtggagttgtcgaatacgtatcatcttcatgtccgtccgggagatcaggttattaaaaaattaggcggacttcataagtttatgaactgggatcgtccgattcttacagattcaggtggatttcaggtgttttcgctggcaaaattaagaaaaattaaagaagaaggcgtttattttaattctcatgttgatggaagaaaaatctttatgggaccggaagagagtatgcagattcagtcgaatttaggctctacgattgcaatggcatttgatgaatgtccgtcaagtgtggcagacagagagtatgttcaaaattccgtagaacgtacaacaagatggcttgcaagatgtaaagctgagatgaaccgcttaaattctttagaagatacggtgaatccgcatcagttgttgtttggtatcaatcagggagcaatctatgatgatatccgtatcgcacacgcaaaagaaatttctaaaatggatttggacggttatgcagttggtggtcttgcggtaggagaaagccatgaagagatgtaccgaattttagatagtgtagtaccatatcttccggagaataaaccaacttatctgatgggagtaggaaccccggcaaatattttagaggcagtttcaagaggtgtggatttctttgactgtgtttatccaagcagaaacggacgacacggacacgtgtataccaactttgggaaactgaatttattcaatgcaaaatatgaactggacagccgtccgattgaagaaggatgccagtgtccgacctgcagaagctacagcagagcctatatccgtcatcttttaaaagcaaaagaaatgcttggaatgagactttgtgtgcttcacaatctgtacttctataatacaatgatggaagaaattcgcggagcaatcgaagaaggacgttacgaagaatataaacaggaaaaattagagcgtatggcagcaggaccaaaagattgatttttggtagagaagcttgaaaccagtctttgatagaaaaacgaaaaataaaaaatctatgaaaaagaacaaaaaggcttgaagtcacgcataaaattgtgtattatggtaataacgttcaaataggcaggaggaactaaaatgtttttagcacaggcaagtgcaagtggaacaggagcaatcgcatccatgttaataccgcttgttatattttttgttttgatgtatttcatgattatgagacctcagaagaaagaacagcagagagtcagttctatgttatcttctatggaagtaggagacagcgtggtaacaaccagcggtttttacggaactctgattgatattacagaggaagatgtaatcgtagaattcggaaacaacaaaaactgcagaattccgatgagaaaagcggcaatcgcggaagtagaaaaagcaagcgatggaatcgtagaaaaataaaacggaaaaacaaaaatagaaacaaaaaaacagaaacagatgttacgggcttttagcaggtggcatctgtttttttaaattcataggaaatttcgtcctgtgaattcaaaaaaacattaaaaattcattctgccttaaaaaggagaagaggttatggcatttatcagtttatttgaagtaatcggaccaaacatggtaggtccgtcgagttcacatacagcgggggcggtttctatggcactgcttgcaaggaaattatttccggcggaaatcaaaaaagttgagtttacgttgtatggttcttttgcaaaaacatatcggggacatggaacagaccgtgcactgcttgggggaattatgggatttgagacagatgatttgagaattcgggattctctttcaatcgcaaaagaacgaaatctggactatcatttttcaattggacaggatacaggagaagaacacccaaatacagcggatattgatatgacaggggtaaatggagaacggctttttgtaagaggcgtatccattggagggggaaaagtaaaaattgtacgtttaaatcagattgatgtggattttacaggagaatacagtaccttaattatcagtcagacagaccgtccgggagttgtagcgcatattacaaaagtgcttagcgaaagagaagtaaatattgcatttatgcgtctgtttcgggaagaaaaaggtgcaaaagcatttacagttgtagagtcagatgagagaattccggatgaggttgtggaacagatacgggaaaatcctctggtttcggatgttatgctggtacagatttaagaagaggcaggagagaatgatggattttaattatgcaggtgagttgttaaagttatgtgaggaaacgaaacttccgatatctgaggtgatgaaacggcgtgaaatggatttttcttctatgacagcacaagaggtcgaagaaaagatgagaaagtcgctggaaattatgaagacggcggcaaaagagcctttggaaaatgaaaaaccgtcgatgggaggactcatcggaggagaagcgaaattattattttcacaaaaaggaaaagagaaagatatctgtggagatgtcgtgttaaaagcaattacttatgcgatggcagttttagaagtaaatgcctcaatgggtgtgattgttgcagcaccgacggcaggttcagcaggagtcattccaggggtatttcttgccttaaaagaagaaaaagcattgtcagatgaaatcttattaaaaggtctgtatactgcaggtgcagtgggatatctgcttatgagaaatgcatccgtagcaggtgcggaggcaggctgtcaggcagaagtcggtgctgcaagtgcaatggcggcagcaggtgtagtagaaatgtttggcggaacaccaaagcagtgtctggacgcaggctctctggcactttctaatctgttaggtctggtctgtgacccgattgcaggacttgtggaagcaccctgccagaaccgaaacagcattggagcgacgaatgcattaatctgtgcacagcaggcattagcaggaataaaagccctgattccatttgatgaaatggtagaagcgatgtatcatgtaggaagaagtctgccatttgaactgcgggaaagtgcacttggtgggtgtgcgggaacaaagacgggatgtcagaaaacctgtgaaattttccggaaaaatgaataaaaatgcataaaaaaaagaagtgttatagcttatataacgaaaaagaatagccaaacactttattatgccttgaaataaagcccaaaaaggattatcatatttagataaaaagtgacaaaatttctggaagggagagagaactcatgaattataatattgcacttatttcaggagatggcattggtcctgagatcgtagcagaagcaaaaaaagtactcgataaagtgtgtgaagtgtacggacatactttttcatataaagaggttttattaggaggagcatccattgatgttcatggtgtaccgcttacagaagaagcaattgccgatgcaaaggcttcagatgcagttttgatgggttctatcggaggagatgcaaaaacttccccatggtacaaattagagccatccaaacgtccggaggcaggtcttttagcaatcagaaaagccctgaatttatttgcaaacttaagaccggcttatctgtacaatgaattgaagggagcctgcccgttaaaagaagaagtaatcggtgatggatttgatatgattatcgttcgtgagctgacaggcggtctgtattttggagacagaaagacttatgaagaaaatggtgtacagacagcagtggataccctttcttataatgaaaatgaaatccgcagaattgcagtcaaggcatttgatattgcaatgaagagaaagaaaaaagtgacaagtgtggataaagcaaatgtgctggattcttccagactttggagaaaagtagtagaagaagtggcaaaagattatccggaagtcacattggagcacatgctggttgataactgtgcaatgcagttagtacataatccagctcagtttgatgtgattttgacagaaaacatgtttggagatatcttatccgatgaagcaagtatggtaacaggttctatcggtatgctttcttctgcaagtttaaatgaaaccaaattcggtttatatgaaccaagccacggttctgcaccggatattgcaggaaaaggaattgcaaatccgctggctaccattttatccgcagcaatgatgcttcgtttctctctggacttagacaaagaagccgatgcaattgaatccgctgttcagagcgttttaacagaaggataccgtactgtagatatcatgcaggatggaatgaaacaggtagggacggcagagatgggcgatttaattgcaggacatatcgcataaaagtatcgtatcaagaaaggatgttaagaaaatgaaaagtgatgcagtaagaacaggcatgcagcaggcacctcatcgttccctgtttaatgctcttggaatgacaaaagaagagatgtcaaaaccgttagtaggtattgtaagctcttataatgaaattgtaccgggtcatatgaatctggataaaattgtaaatgcagtaaaacttggagttgccatggcaggcggtactccggttgtatttccggcaattgcagtctgtgatggaattgcaatgggacatatcggtatgaaatactctcttgtaacaagagatttgattgcagattctacagaagcgatggctctggctcatcagtttgatgcccttgttatggtgccaaactgtgataaaaacgtaccgggtcttttaatggcagcagcaagaatcaatgtaccgactgtttttgtaagtggcggtccaatgttagctggtcatgtaaaaggacaaaaaagaagtctttcttccatgttcgaggcagttggttcttacagcgcaggtacaatgactgcagaagatgtagaagaatttgaaaataaagtatgcccgacctgtggttcctgttctggcatgtatactgcaaacagtatgaactgcctgacagaagtattgggtatgggattaaaaggaaacggaacgattccggctgtttattctgaaagaattaaacttgcaaaacatgcaggtatgcaggtaatggaaatgtaccgcagaaatatccgcccacgtgatattatgacaaaagatgcaatcatgaatgcgttaacagttgatatggcgcttggatgttctacgaacagtatgttgcatcttccggcaattgcacacgaaatcggatttgattttgatattacatttgcaaatggtgtcagtgcaaaaacaccaaacctctgtcatttggcaccggcaggttctacttatatggaagacttaaacgaagcaggcggtgtttacgctgttatgaacgagctggctaagaaagatttattaaatctggattgtatgacagtaaccggaaagacagtaggagaaaatatcaaaaactgtgttaacttaaatccggaagtcatccgtccaatcgacaatccatacagccagacaggtggacttgctgttctgacaggaaaccttgctccggatggtggtgtggtaaaacgttctgcagtttgtgaagaaatgatggttcatgaaggaccggcaagagtatttgactgtgaagaagatgctatcgcagcaattaaaggcggaaagattgtagcaggagatgttgtagttatccgttatgaaggaccaaaaggcggtccgggtatgagagaaatgttaaatccaacttctgcaattgcaggtatgggtcttggttcaagcgttgctttaattacagatggacgtttctcaggtgcctcaaggggtgcatccattgggcatatttctccggaagcagcagtaggcggaccaattgcactggtagaagaaggtgatttaatccgtatcaatattccggaaacaaaactggaattagtggtatcagatgaagagctggagagaagaagagcaaactggcagccgagagagccaaaagtaacaactggatatctggctcgttatgcttctatggttacaagcggaaaccgtggtgcagttttggaaataaagaaataaaaaaacgttgggagggcttcgagatgcagttgacaggatcagagattgtaatcgaatgtttaaaagagcagggtgtggataccgtatttggatatccaggcggaaccattttaaatatttatgatgaattgtataaacacagtgatgaaatccatcatattttaacatcccatgagcagggtgctgcgcatgcagcggatggatatgcacgttcaaccggaaaagtaggcgtctgttttgcaaccagtggaccaggagcaaccaatctggtaacaggtattgcaaccgcatttatggattctgttccggttgttgcagtaacttgtaatgtaggtgttccgcttcttggaaaagacagtttccaggaagtagatattgcaggtgtggtaatgccgattacaaaacacagctttatcgtaaaagatgttacaaaacttgcaaaaacactcagacgtgcgtttgcgattgcaaaaagtggcagaccaggaccggtcctagtcgatattacaaaagatgtaacagctgcaaagactgaatacacaaaggttgagccaaaagaaatcaaaccgtttgtctctgaaattaaagaagaagatttagaaaaagcggttgagatgattcaggaagcaaaacgtccgtttatctttgtaggtggaggggcggttgctgccgatgcatggaaagaagttcgtgaactggcacataagattcaggcaccggttacagattctttaatgggaaaaggtgtttttgacggcgaagatgaactttatactggtatgctgggtatgcatggaacaaaggcatccaatcttggtgtgaccaaatgtgatttgttgattacgattggtgcaagattcagcgaccgtgtaaccggaaatacaagaaactttgcaagaaacgcaaaggtacttcagattgatgtagatgcaaccgaaatcaataaaaatattttagtagactgtagtgttttaggagacgcaaaagtaattcttcagaaattaaatgaaaaaatatctgaaaaagagcataaagaatggatagaaaccatagaagaattaaaagaaaaatatccgcttcgctataatcaggaaggtctgaccggcccggcagtcattgaagaattatatcgtcagacgaagggagacgctattattgtaacagaagttggtcagcatcagatgtgggctgcacagtattataaatataaaatgccgagaagatttttatcttccggtggacttggaacaatgggatatggacttggagcagcaatcggtgcaaaaactgcaaatccggataaagttgtcatcaatgtagccggagacggatgtttccgaatgaatatgaatgaaattgcaactgcgacaagaaacaatatgccgttaattcaggttgtcatcaataaccatgtattaggaatggtacgtcagtggcagactttattctatgatcacagatactcaaatacagtattaaatgacaaagtagattttgtaaaactggcagaagcgatgggagcggtaggaatccgtgtcacaaaaaaagaagaacttgccgatgcaattaaaaaggcaattgaattaaatacaacagttgtattagactgcattattgattctgatgataaagtattcccaatggtaccggccggtgcaaatattgaggatgcatttgatgaggatgatttaagagcaaagaaaaaataaaaaatagctgttttagtcgaaaaagagtttggctggacagatggatgtctttgtaataaagacaaatgtttatattgacaaaaatatgtcaaagatgtagaatactctttatacaaataaagagtattctattattctatacgggaggaacaaagaagtgagcagagtgtataatttttcggcaggaccagcagttttaccggaagaagtgttaaaagaagcagcagaagaaatgttagactacaatggaagcggtatgtccgtaatggagatgagtcaccgttcaaaagtatttgatgaaattattcagactgcagaagcggatttaagagacctcttaaagattccggataattataaagtactgtttttacagggcggtgcaagtcagcagtttgctatgattccaatgaatctgatgaaaaacagagttgcagactatattgtgaccggacagtgggcaaaaaaagcatggcaggaagcccagaaatatggaacagcaaataagattgcatcttcagaggataaaacattttcttacataccagactgttcagaccttccgataagtccggatgcagactatgtatatatctgcgaaaataacacaatttatggaacaaaatataaaacattaccaaatacaaaaggaaaaatccttgtatcagatgtgtcctcctgtttcctttctgagcctatggatatagaaaaatatggtattgtttatggtggtgttcagaaaaacgtcggaccggcaggtcttgtgattgcaattatccgtgaggatttgattacagaagatgtacttccgggaactccaaccatgttgacttataagacacatgcagatgcaaattccttatacaatacaccaaactgctatggtatttacatttgcggaaaagtatttaaatggctgaaaaaacagggcggtcttgaagcaatgaaagaacgtaatgaaaagaaagcaaaagtgttatatgattatctggacagcagtaaattatttaaaggaacagttgagccggcttcccgttctttaatgaatgtaccgtttgtaacaggagataaagaacttgatgcaaaatttgtaaaagaagcagaagcagcaggacttgtaaatttaaaaggtcatcgtacggttggcggtatgcgtgcaagtatttataatgcaatgccaattgagggtgtggaagcactggttgaatttatgaaaaaatttgagaaggagaacgcatagacatgtataaatatcattgcttgaatccaatttcaaacgtaggactggaatattttccgggaaaatatgaaaacagtgaatctcttgaagacagcgatgtggtactggtaagaagtgcaaatatgcatgagatgcagcttccgaaaaatgttgttgcagttgcaagagccggtgccggagttaacaatattccgttagaagactatgcaaaagaaggtgttgtcgtatttaatactcctggtgcgaatgcaaatggtgtaaaagagatggtaattgcaggtatgttacttgcatccagagatatcgtaggtggaattgaatggttggaaaaacaggaagcaaccgacgatatcgcaaaacttgcagaaaagaaaaagaaacagtttgcaggctgtgaaatcagtggaaagaaacttggaattatcggtcttggagcaatcggtgttaaagttgcaaatgctgcggtgcatctcggaatggatgtttacggatatgacccatttatttctgttgatgcggcatggaatctttcaagaagtattcatcacatcaatgatttaaatgtgatttataaagaatgtgattatattaccattcatgtaccgcttctggattcaactaagaagatgattggtgcagatgaaatcgcacagatgaaagacggtgtggtattgttaaactttgcaagagacttgctggtagatgaagaagcacttgccgaagcattaaaagcaggaaaagtaaagaaatatgtaaccgactttgcaaatccattagtggcaagtacaccaaatactttagtaacaccgcatcttggagcttctacagaagaatccgaggataactgtgcagtgatggctgtcaaagaattaatggactttgtagaaaatggaaatattaaacattctgtaaactatccggattgcagtgcaggaacttgtgtggatgttggaagagtgacgattaatcataaaaacattccaaatatgattagtcagtttacaaaagcattaggtgatgcaggagtcaatatttcaaatatgacaaataagagtaaaggtgattttgcctataccatgattgatgtatccactccgatttcttcagaagtgacaaaggcattaaaaaatattcagggtgtttatcgtgtcagagtgattaaataaaagataattaagaaaggcagggctggcagtttttttctgcatggctctgtcttttttactttatccaaatttaaggagagaagaaaaatgtcagatatcagaccgttttgtgcagtgcgtccaaacgaaatatttgcatctaaaattgcagcactgccttatgatgtatacacaagaaaagaagcgaaaaaagaagtagaaaaaaatccattgtcttttttaaagattgaccgtccggaaacgatgtttcctgatgagatggatatgtatgcaccaaaagtctatcgaaaggctcgtaaggtgttggaagagatgatagaaaaaggagaattcattcaagatgaaacaccttgttattatctctatgagctgaccagaaatggtcacagacagaccggaatcgtagcctgtgcttcaattgatgactatttcaatggaacaataagaaaacatgaaaatacaagagaagaaaaagaacaggatcgaatccgccatgtggatacactggacacccagacaggaccaatttttcttgcctatcgtttggatgctgttttaaaagaaattatcgaggaaacaaagagaaaagcaccggtttatgatttcatttcagaagacaaaattacacacagggtatgggtgattgatgaatcagaaatgatggaaagaatacaacaatgttttgtaaagataaacaaaatttatattgcagatggacatcacagggcggcttctgcaatcaaagttgggtgtaaaagaagaaaagaacatccaggttatacaggagaggaagaatttaattattttttatgtactttatttgcagaggaagaactggaaatcttagattataaccgtgtggtaaaggatttaaatggtcttagcgaaatagaatttttagaaaaaatcaaagaaagttttgaagtggaagaagcagaggaaagtccttatgcgccaaaacagaaaaaagaatttgggatgtatcttggaaagaaatggtataagcttcagattaaaaaagagcaggtttcagatgatgtagtcgaaagcctggatgtgtctattttacaaaataaattgttaaaaccgattcttggaatcaaggaaccaggaaaagacaacagaattatctttgttggaggaatccgcggattaaaagagttggagcattgtgtggaaaatggttttcaggtggcattttcaatgtatccgacttctatgcaggaacttttttctgttgccgatgcaggcagattgatgccaccaaagtcaacctggtttgagccaaaattaagaagtggtttattccttcataaaattgggtaacggttagtcagaattgaaaaaatattccgctgtaagtttgtttttgtaatttgtagtgttagtttacaatttcacactttaatgttaaaataaacaaaaaggagagtgtgttatgtctgataaattatatgaatacatggattggcctgagatagaggcagttgtttattctgaggagagcgagccacgtaagattttaggacctcgcgtgacagaagatggaattttaatacagagttttttgccaaatgcggtaaaagcaaatattattgtaacaaaaacaaaagaaacgtatgaaatggttagggaagatgaagctggttattttgcaattttaattccggaaaaagagattccaaaatataaaatcgaaatagaagatgaagagggaaaaaagagcagtttttatgacccttatgcatttccaaaacagatttcagtcaatgaagaacagcagttttgtgccggaatcagttatgaaatttataacaaattaggggcacatgtaatgacaataaatggaatcaaaggtgtttactttgcagtatgggcgccaaatgccatgcgtgtgtctgtcgtgggagatttcaaccactgggatgggagagctcatcagatgaaccgtctttcagtgtccggcatttttgaattatttattccgggagtaaagccaggtgcattatataaatacgaagtaaaggccaaaggttctctggtttatttaaaagcggatccttatgcaaacgaagcagaattaagaccgaaaaatgcatccatagtggcagatttaaagagctataaatgggaagatgaaagctggatgaagaatcgaaaagacgtcaataatgaagaaaaaccgattctcgtctatgaaatgcatttaggctcttggagaaaaccggaggatcggctgttttatacttaccgtgaacttgcaccacaggttgccgagtatgtaaaagagatgggatatactcacgtggaactgatgccggtgatggaacatccgtttgatggttcctggggttatcaggtgaccggatattatgcaccgaccagccgttatggaacaagtgaagattttatgtattttgtggattatcttcataaacagggaattggtgtgattttagactgggtgccggcacattttccaaaagataattttggactgtctaattttgatggaacttgtctgtatgagcatgcggatccgagacagggcgtgcatccacactggggaactttgatttttaattatggacgtcctcaggtttccaattttctgattgcaaatgcaatgttctgggcggataaatatcatgtagatggaattcgtatggatgcagttgcttctatgttatatctggattacggaaaaaatgacggagaatggattccaaatatttacggtggaaatgaaaatttggaagcaattgaatttttaaaacatttaaattccatgtttaagaaaaaatatccggatgcattgttaatcgcagaagaatccacagcatggccgaaaattacaggtgaactcaatgatgaaggacttggatttgactataaatggaatatgggctggatgaatgattttatcgattatatgaaaaaagacccgctgtttcgaggtggtgcacatgatgaattgacattcagtatggtatatgcttatagcgaaaaatttatgctgtgtttgtctcatgacgaggttgtacatggaaaggcttctcttttgatgaaaatgccaggaacaatggaggaaaaatttgcaaatttaagagctgcgtatggattcatgaccgtacatcctggaaagaaattactgtttatgggacaggaatttgcacaagaaagagaatggtcggaagaaagaggtcttgactgggaactgttagagacaccggaacatgcacagtttcaggaatatgtaaaggcattgtggaaattttacagagaggctcctgcactttatgagctggatgatgatccggatggttttgaatggattaatcatatggaatctgaaaaaaatatgctgactttaatccgaaaatcaaagaaaaaagaagagactttggtaattgtctgtaacttctcagcactgaaatatgaaaaatatcaaatgggtgttccttatgccggcaaatacaaagaagtatttaacagtgatggaaaacaatttggtggtacaggagcaggaaatccaagattaaaatcatcgaaaaaaacagaagcggatgagcgtaaaaattcgcttacaattacggttgcaccacttgcaattcagatttttgcgtttaaggaagcggaaggagagaaaaaagcaccgaagaaaacagttcggaaagcacttgaaaagaaaatagaaaaagaacgggaaaaagaattaaaacagcaggaaattaaacttccaaaagaagaagtaaaatcaatgccggaaaaatcgaaagtaaagccggaaccgaaaaagcttgaggcaaaaccagagccacaaaaactggaagcaaaaccggaaccggaaaaacttgaggcaaaaccagagccacaaaaactggaagcaaaaccgaaaccgaaaaaactggagagaaaaccaaaaaagaggggaagaacaggaaggaaaaaataaggaaataacgtatgaaattggatttatatttagcccagacaacagagttgcaaaaaatagcgagccgtctgttagagggacttcctaccattgaaaaatgggtctttcgggttttactttccgtgattgcatattttgtggtcggaaagttaattaagaaagtctgtaatttcctgaagacggcattacaaacagcaggagtggaagttggggcaacccagtttatctcttcatttgcaaaagctgcaatgtatgtggtacttttgatgataattggagtacagcttggaattaaggaatcatcgcttgttgcagtattggcatctgccggtgcagctctggtactggcactgcagggaggtctttccaaccttgcaggaggggtaatcattcttgtacttcagccgtttaccgttggagattatattattgaaagtacaaataaacaagaaggaacggttgtgaaaatcgatttgttttatactactttgaccagtgtggataataaaagaattattgttccaaatggtactctgacaggtgcaagcattgtaaatgtaactgcacaggacagacgaaatcttgagattaagattatgatttcctatcaggcggatttaattaaggcgaaatctattttagataggcttttaagagaagatccgactacgatgtcagataaagaaatgaaagtatttgtcgatgaactggcggatgacggtgtgattatcggatttcgtgtatgggtaaaaacagaagattactggccgacaaaatggcgtttaaatgaggcaatcaaacttgcatttgatgaagaaaaaatagaaattccatacccacagttagatgtgcatattaagtaacaggacacaaatctgtatctattttgctatgcagtgttgatagaaaatgaatacgctgtcatgaaaagtctgctgaacataagcgaacaaaacgtgcagaaaggagcagtcttatgaggaaatttagattactgccggtaattgcggtaagtacagtcttgatgatgggaatcacaggctgtgaaagtaccacacaacaaccagcaaaagaagagacaaaaaaagaagaaacgaaagaggaagagacgaaacagcctgaaacatccaaagaaacggattcagaatcaacagaaacaaaagatacaacagaagaaaaagacggaaaagattctgaagcagagaaaaaagaagatattacaaaagaaacagaatcagaaaaatcgcaggaagaacagttgaccttatatttgccaaatgaaaatgcggatggctggaatgttacaaaaaaccagatagagcaggttacaccagatatcatcattggacagcttgtaggggcaggtgcaattccggacagcgtgacagtagtaagttttggagaagatcagggagaaaatggtttgattttgaaactggatttatcttctaattttgtagaaggacttctcaatatgggaacggccggcgaatatcttacaatgggagctgtggtaaatagttttcttgatacttatcaggcagatggaattgagataacagctggtggaaatgtgattgaaacaggtcatacgtcatttgaaggtgtgttaaatcatttcgattcgaatgaaagtcaataatgcataagttaagatagagtgagaactgttttgaaatttaaaatgatttttggggacatggtattttggatgccatgtcccctttgtttatagacaatttataatttttaattgacaatacatattattttggaaattttcgtggtatcattaaacacaagaagagatgaagaggatatggagttgatcagagaatgaaaacacaggtgttgtatatgagcagaactggaaataccgaaaagattgcacaggcgattttttcagcaattccaggaaaaaacaaagatattgcaaggtttgcaggacaaaccgattatgatatgggagatatttattttattggattttggacagacagaggaagtgcaagtgtagaagttttggattaccttggttctttacagggaaaaaaaattgccctttttggaacttgtggaatgggagaaagcattgaatattatagaaaaatagaagaacgtatcaaagtatttattgaagatggaaatcagtatctggggtgttttttatgtcagggaaagatgccgatgcaggtgcgggagaaatacctgaaaatgaggcatcctggaaatgagggacaaattcagaaaatgctgcagaattttgataaggcactgcttcatcccgactggaaggatatggaaaatgcccagagatttgtgcatagaatatacagtagattatagaacaggatgtgagaagaaatgaaagaaaaaattggaagatttatggcgggaagatatggaaatgacaaattaaatcagtttatgatggcagtatttttaggatgcgcagtattaaatctgtttgttcggaatgcttatgtttcgacggttttaaattcatgggaatgtttattgattttgctggtttatattcggatgttttccagaaatatttcaaaacgttatgcagaaaatcagaaatatctggcattggaaaaccgtctgcgtcgtttttttggacagaaaagatatctgatgcagcagagaaaggaatatcatatttataaatgtccaggctgtaaacagaaaatcagaatcccgaggggaaaaggtaaaatcagtatccgatgtccgaaatgtggagaagaatttatcaaaaatagttaaaaaataacttgattttttgtagaaaatctagtacaatcatctttgcagtgataagctgaaatagctcagttggtagagcacttcactcgtaatgaaggggtcgtgggttcgagtcccattttcagcttttccaaattcaagctatctgtcaaactggcaggtagcttttttaatttatcccttgttcttttcctgaataaaacttaagggaactggaaagagtatttgtatgttctcgggtaaaggagaagaagattgaaaatgagaattataatagttgcagtgataatctgtttcagtatatctgggtgtgaagcgaaagacacagcgcaggacagagaactggtaaaaatcagaacaatagagaaaggggacgaaatacaggatggaaaactatgctttttctccctggaaagaggggagaacacaggaagagaaacaatatctgctacaggcagaggaactagagattgaagatggagtcgaagcgattggaaattatacattttatggatgtagaaatctaaaaagcttaaagtttaccgattctttgaaacagattggtggtggttcatttacggggtgttcagcacttagaaaactttatgtaaaaatgaataaaaacatgccaagctgtatcaaagatgttgttgcagaaacctttcatgaagtctatgtgacaattgaatttcgggaaacaggagagtttgcaaaattaatctttccggagtattatgaagaaggtgtggaaaatacaccggcgagaattttagagacacactttcatggctgcgggtatcgttatcgccagtgctttacagataagaaagtagactatcatcaatatgattccctttttaaagtagcgaaggtctatgaaaaacaggatattttaattccgatggcgctgggaaggctgatgcatccttatgagctggcggaagaacacgaagcagattatcggcagtacataacagaaaagctggaagagaccggaatctattatttaaaacgggaaaactggcatgagggactggcttatctgataagaaagggagtctcaaaaagcgaagaagcggagcagttgattacccttgcatcaaaagccgagcatacagaagcggtcagctttttgatggaagaaaaaaagaaacgttttggaagagtgaaaaaaacatttgaattttaaaagaagagtgatggaacagacatggcggaaaaaatagaaaagagaatcgaagaggtatgtgagcgcatgcttttttcagcgagaagtgaattatatctgcatctgcgttttcttgacgtagctttatcgatgttttcttatgcattagaaccgagtttggagacaatcggaagtgacggaagaatcatttattataatcctgcctatttaggggggatttaccgacagggaagagtgatggtaaatcgtgcttatttacatattgtgtttcactgtatttttgcgcatccatggaaagataccagaatccgtaaaaaaagagcaggttatgagcttggaatcaaaagagaatccggacaggaagatttaaccgatttattatgggacatttcctgcgatattgcagtggaacgaatgatagatgatctgtatctgcattgtatccgaaaaccgttatcaccgtttcgcaaagaaacctacgagtggctggaaaaagaaaagagtgtattaaatgcggaaagtattttttcggcactggtacatcgaaagacggatgaagcttttgcagggcggttaaaacaggaatttgaagtggatgagcatcgtatctggagggagcgaaatcgccaaaatcagagacagaatccaaaagaggattgggatgatatccgtgaaaaaatgcagacagagatggaaagctttggggatgagaaagataacggcgcagggcagagtatgcttgaaaaaatcaaggcagaaaacagagaacggcatgattatcggcagtttttaaaaaaatttgcggtgttaaaagaagaacagcagattgatgcggatgcatttgattatggcttttatgcgtatggattatccctatatggaaatatgccgctgattgaaccacttgagacaaaagaagtcaaaaaagtagaagagtttattattgcgattgatacgtcgatgtcctgctctggagaactggtcaagcattttttggaagaaacctggtcgattttaagagaaacggacagtttctttcatactgtaaatattcatatcattcagtgtgatgaagcagttcgaagagatgataaaattacttcaaaagaagaattagaagaatatatgaagaaccttgaaatagagggaaagggcggaacggattttgtgccggtatttacttatgtacaggagctgcttcgaagaaaagaattttccaatcttcgaggattattgtattttacagatggaaaaggaaggtttccaaagaaaatgccgccttatcagactgcatttgtgctggtgcaaaaagagtttgaagaggttgaagtgcctccatgggcaattcggatttatcagacagaagaagatggatatggattaggagaaaaaaaggatgaacattaaacgagccaaaaatgagattaaagatgcaattgaagcttatcttttaaaggatgaatatggaaattatctgattccggaaatccggcaaagaccgcttcttcttatgggacctccgggaatcggaaaaacacagattatggaacagattgcaagagagacaaagattaatctggtttcttatacgattacgcatcataccagacaaagtgcggtcgggcttccgtttattaaagaaaaagtgtatgataacaaagcgtattccgttacagaatatacgatgagtgagattattgcgtctgtctatgaacagatagaaaagacagggataaaagaaggaatcttgtttattgatgaaattaactgtgtatctgagacgcttgcaccgacgatgcttcagtttttacagtgtaagacctttggaaatcaggcggttccaaaaggctgggtgattgtggcggcaggaaatccaccggaatacaacaaatcggtacgtgaatttgatgtggttacattagatagaatccgaagaattgatgtagaggaagactttcaggtttggaaagaatatgcttatcaggcagggattcatccggcaattctggcttatcttgagattcataaacagaatttttaccggatggaaacgagtgtggatggacgtttatttgtgacagcaaggggctgggaggatttatctcagtttttatatgcttatgaacgtctggaaaaacgggcagaccgtgaagtaattggacaatacctgcagtactggaagattgcaaaagactttgcaaactatctggaactctttgaaaaatataaaacagactatcaaattgaagcagtgttagaaggcagatttgaaaaatttgcaattgataaattaaaaattgcttcttttgatgaaaaactcagtgtagtaggattattaatcggtcaccttggaaaagaattctatacctattatgagaatgatttgtttgtcacagaactgtttgaacggttaaaaaaattaaaacaggaattggaaaatgattcagaggaaaccgcaggtgcaattctcgaaaacagaattacaaaagaacaggaacggtttgagaaaaaagaagctgcaaagcagttaaccgttccacaaagaactgcattggttcggatgctttcatttttaaaatctgcgcataatgtggtcaaagagaaagaagaaaaaggaacaccaaaaggagaagtctttgaagtattagcaggattgtttaaaaaagagacagaaaagcgggaagaacagatagaaaaaacatcccaaaaattgcagtatgcatttgattttctggaattagtctttggagaaggacaggaattggttctttttgtgacagaattaaataccaatccgtacagtgtttcctttatcagtgaaaatggttgtgacagttattataagtataataaaaaattattgtttgaggaagaacagggcgagattttaaaagaactgaatcagatagaagaagagatgtaaaaacgactcctgcatacataaaagaaatgtaaatgtatgcaggagttttttggggtattattcgatgccgacttctttatgaatttcttcaattgcaagtttaaatccattttgtgcagctttcatacgccaggtgtccgctaaatcaatgtctttttcaacgccttctccatagcgatataagatagaaagattgtactgggcagcagggatatttgcgtttgcagctttttcaaagagctggaaagcacgttccggcatacatggaacggcctgacccatcaggaaataactgcccatacagcacattgcacggtagtcattttgttctgctgcttttttataccagtcaaatgcacggctgtagtcaacaacggttccgattccttcttcgtaacagcgtgccagattatattgggcatttttatctccggttttagccgctttttgaatatactccagagctttctttccatttttttctacgccttttccctgtgcgtaaaacattccaagatgcatcagtgcttccacatgatttttggaagctgctttttcataccattcagccgcctgcttaaaatctacttctgtgttaattccattttcatagtaatagccaacagcatactgcaaatctttctggccgttttcagcaaggatttttaattcatccagtgtaaattctgagtttttaaggttcatattttttctccaatttcctaagtatttcttctctctattttaaaacaataagaagtagaaagcaatggaatttctgaaagaaacgtattataataaagacaagttggggaaaataaaaaagtattcaaaagctggtttaaaatgcaggtttggaatacataggaaaaaggagaaggactatggtttataacaatgtacgacacgaatgtaatctttacaatttcttttttgcaccaaggggaaatcgtagaatgatggagcttgggcgaaaaattgcgcagatgtatttaaatccgtttgataagatcatcggaattataggggcaaaagactgcggaaaaagtatgctgattaagggaatgtttccgggaattcagattgtagaaggggacgacgaatttgattttcagaatatgccgctaatgaatgcagaagatgttggattttatacaccaagaacctttcatgtagatgtaagagccgcgtcaaaatttatttcgcttgaaaaaattgcacaggcaattttagatgtgacaaaacagcagaaaagagtcattgtagaatactttgagatgttgtatcctgtattaaacagaaatgcagatttgatgattggaattggtgaggaagtcattgtaacacgtccgtctttgtttggaccactgcctcaaaatattgccgatattgtatataaatctttgatttatcgtaaaatggcacacagcgcagaggatttatacggttatgtagtccgcaacatggagcgtccggattatgttcgttccgatattcgtcatggttttgtgctggattacgtagaaaaaccgattaactttgatttggaatatattgaagataagataaagagtctgattgcaaaggatttaccgattcgctattatgatgaggaacatatcaaaatcggagacgaaattcttgcatgtactggtcctctgatgcatgtggaaagtaccggacaaattgaaaatttctcgatggtaaaaaaattcttccatgatgcaagatttggatattatattgtagcgggtacggttgggcataaagaagaggaaagtgaccgtctcaatacgattgatattatgacagcagaataagaaccccaaaaggtcaggtaaaaacaaaacggacagtagagtaaacagaaaagaggataaaatatgatgttattagcgcagacagatttttattatgcaaacagaggaatgggctggggatttgatggaacttatgtgctgattatactggcttttttgatttcagcactggtttctgtaaagatgaatgccacattttcaaagtacagtaaagtgcgttcttactgtggaatgacaggagcacaggcagcacagcgtattttaagcagtgcaggaatttatgatgtcagaattgaacacgtaagcggaaaattaacagaccattacgatccttcaaataaggtgttacgtctgtctgatgcagtctatggaaatacttccattgcggcaatcggggttgcagctcatgagtgtggtcatgcagtacagcacgcaagaaattatgttccgttgtctgttcgttcggcaattgtaccagttgcaaattttggttcacagttatcctggccgttatttttagctggattaattttttcctttcgtccacttttaatgattggaatcttgctgttttgtgcagcacttttgtttcagattgtaacactgccggttgagtttaatgcttctgcgcgtgcacttcggatgctggatgagactggaattatggggaaacaggaaattcgtggaacaaagaaagtattaagagcagcagcgatgacttatgttgcagcagtcataggctccttgttacagcttttaagacttttgattttatcaggagcatttcgcagaagagatgactaaagagaacaagaggagaagaataggatgtttgagagaatcgattatatcgtaaagcagattgatggagattatgcttatttagaaagattagaaaagccagaaggacaggaagatgagttaaaatgtgttgcgcgcgctctgcttccaccggaaattatggaaggcagccgtctggcatatgaaatgcttcagtatacaataatttaagaatttaagaatttaagaaaatccctgttttgtattgatttggttatgagcaagtagcgaagcggattgcgaatatccacttgactcgcttgacatttacgaaacagggaaattttttatgaataaatgttaaaaatataacgaaaaatgcaagcgaaatagtctgaaaaattaggcagaacacaaaagaaataaataaaattcttgtataaaaagaaatacaagccaaaaaaataaataaaaataagattagctatacctaactattgtgtaaaaagtagaaaaatgtttattttttaacaaactattgctttttaaatttaatcttgatagaataagtacgaattaagaaatccgttttggatatcctaataagagattaagagactacgaaaaaatgctcaatgatgcaggaggaaatgacgatgaaaattttattttatgatacaaagagttacgataaagaatcttttgaaaaacagcttgcaaactttccggaagtggaaattgattttatgaaaaccgaccttgctccaaagactgcaccactggcaaaaggatttgatgcggtttgtgcatttgtaagctctgatatcggtacagagactgtagaaaaactgcatgaagcaggggtaaaactgattttgcttcgttgtgctggatttaacaatgtagatttagaaaaagcagaagagtatggaatcaaagtgatgcgtgttccgggttactctccggaagcagttgcagaacatgcgatggcactggcacttggagtaacaagaagactgcataaggcttatgtaaaagtaagagaaaatgattttagtttaagtggtctgatgggatttaatttttatcagaaaacagcaggaattgtgggaaccggaaaaatcggtgcagctatggcgagaatatgccgtggatttggtatgaatgttattgcttatgatgtttataaaaatccggatcttgattttgtagaatatgtttctttagatgagttattagagagaagtgatttgatttccctgcactgcccgctgatggataacacataccacttgattaataaagaaaccattgctaaaatgaaagatggagtggtacttgtcaacacatcaagaggtggtcttgtcaagacagatgatttaattgaaggaatccgtgcaagaaaattctttggtgttggtcttgatgtatatgaagaagagacaaagaatgtgtttgaggaccgttccgatgaaatcctggagcactccacaaccgcaagactgttatctttcccgaatgtaatgattacttctcatcagggattctttacagaagaagctcttgcagcaatctctgagacaacacttcagaatgcggttgcttttgaaaaaggagaaagcacaggaaatgaagtggtaaaacaggggtaagaatgaatcagaaaagaaattatcaaaaagaacttgaaactgtgatacaaaaggaacaaaaagaaggcagaactccgaaattgttactgcatagctgctgcgctccatgcagcagctatgtgctggagtatctgtctcctttttttgcaattacggattttttttataatccgaatatttcgccgaaagaagagtatcaaaaaagagaagaagaactaaaacgactgattgatgagatgccgatgaaaaataaacctgtatttctggcaggagaatatcatccggaagagttttatcaaatggcaaaaggattagaagatgtgccagagggtggggaacgttgttttttatgttaccggatgcgcctggaagaggcggcaaagatggcagttgagaaaaactgtgattactttgcgacaacactcacgatcagtcctttaaaaaatgcgcagaaattaaatgaaatcggagaagaattagaaaagaaatatggagttcgacaccttccgtcggactttaaaaagaaaaacggttataagcgttcaattgaactgtcaaaagaatacgatttatatcgtcaggatttttgtggctgtgtcttttccaaaagagagcgtgacagacgggagcaggaaaaatcgcttgcacctcaaaacagataatgataaactggtatacaaagcttataaaaaataaagaaatgagggacaaaagaatggctcaattatggggaggacgttttaccaaagaaaccgataaactggtatataattttaatgcgtccttaagttttgattccaagctttacaaacaggatattacaggaagcatggctcatgcatctatgcttgcaaagcagggaattatagaagaacaggaaaaagaagaaattttaaaaggcttaaaaagtattttagaagatattgaaaataaaaaactggaatttacagaagaatatgaagatattcacagctttgtggaagcaaatctgattgaccgttgtggagatgtcggaaagaaactgcataccggaagaagccgtaatgaccaggtagcactggacatgaaaatgtatgtcagagatgaaattggagaaattgaccttctattaaaagagctgttgacttctatttataagattatgtctgaaaatgtacatacttatatgcctggatttacacatttgcagaaagcacagccggttacgctggcacatcattttggagcatattttgaaatgttcaaacgtgacagaagccgtcttgcagatgcgaaaaagagattaaatctctgcccacttggaagtggtgcgcttgcaggaacaacttatccgcttgacagagcctatacagcagaagtacttggttttgacggtccgacattaaacagtatggattctgtggcagacagagattatttaattgaaactttatctgcgttatctactgttatgatgcatttaagccgtttctgtgaagaaatcattatgtggaattccaacgaataccgttttgtggaaattgatgacggatacagcacaggaagcagtattatgccacagaagaaaaatccggatatcgccgagttagtaagaggaaagaccggacgtgtttatggtgcgttaatgtccattcttacaactatgaagggaatcccactggcttataataaagatatgcaggaagataaagaatttacgttcgatgcaattgatactgtaaaaggctgtattgcgctgtttaatgggatgatttctactatggtgtttaacaaagacaatatggagaagagtgccaaaaacggatttaccaatgcgaccgatgcggcagattatctggtaaacaatggtgtaccgttcagagatgcgcacggaatcgtaggtcgtctggttctgcattgcattgacaaaggaatttctttagatgaaatgtctttagaagagtatcaggaaatcagtccggtatttaaagaagacatctatgaagcaatcagtatgaaaaattgtgtggaaaaacgaaatacaatcggagccccgggagcagaggtaatgacaaaagtattggcacttcataaaaaatatctggaagaaaattaaaaaacacttgctttttactaagttttggtatagtattgtttaggaaatacaaatgtacgtgaaaggaaaacacgatacataaaaaatagagaattggataagcaaggagaatttataatgagtgaaaaattaagagttggtattttaggtgcaacaggtatggtaggacagagatttatctctctgttagagaaccatccatggtttgaagtggtaacattagctgcaagtgcaagaagtgcaggaaaaacttatgaagaagcagttggcggacgttggaaaatggatactccaatgccggaagctgtaaaaaaattagttgttatgaatgttgcagaagtagaaaaagtagcttcaactgttgactttgtattttctgctgtagatatgagcaaagaagaaatcaaagcaatcgaagaagaatatgcaaaaacagaaacaccggttgtttccaacaacagtgcacacagatggacaccagatgttcctatggtagttccggaaatcaatccacagcactttgatgtcatcgaattccagaaaaaacgtcttggaacaacaagaggtttcgtagcagtaaaaccaaactgctctatccagagttatgcaccggtactgacagcatggaaagaatttgaaccttatgaagtggttgcaactacttatcaggcaatttccggagcaggaaaaacatttaaagactggccggaaatggtagaaaacatcattccatacatcggtggagaagaagaaaagagtgaacaggaaccacttcgtctgtggggcgaaatcaaagatggtgtgattgtaaaagcatctgaaccggttatcacaacacagtgtatccgtgttccggtattaaacggacatacagcagctgtatttgtaaaattcagaaagaaaccaacgaaagaacagctgattgaaaaattagtaaacttcaaaggtgttccacaggaattagaccttccaagtgctccaaagcagtttatccgttacatggaagaggataatcgtccacaggttactttagatgtaaactatgaaaacggaatgggcgtaagcgttggacgtttaagagaagatacggtttatgattataaatttgttggtctttctcataacacagtacgtggagcagcaggtggagctgttctgtgtgcagaaaccttaaaagcaaaaggatttatcacaaagaaataataagagataaataacgagagcaaaaaaatacatcaggccggagaactccctccggtctgattgcgtgaaagaggagtttatgggcaaatcattatttatagcagaaaaacccagtgtggcacaagagtttgcaaaggcgctgaaagaaccaatgacaagaaaagatggatatcttgagtcagaacatgccgtggttacctggtgtgtgggacatcttgtgacaatgagttatccggaaaaatatgatatcaaatacaaaagatggacgctggaaaccctgccatttttgccagaagaatttaagtatgaagtaatccctgcagtaaaaaaacagtttgagattgtaagcgggcttttaaatcgagaggatgttgagacgatttatgtctgtaccgactctggtcgagaaggagaatatatctatcgtctggttgcaatgatggcaggtgtaaaagagaaaacacaaaagagagtctggattgattctcagaccgaagaagagattttaagaggaatttctgaggcgaaagatatttcagagtacgataatttatcggaatcggcatatctgcgcgcaaaagaagattatctgatgggaattaatttctccagactgttatccctaaaatatggaaatgcggtgtcttcttatcttgggacacggtatcaggcaatatcggttggacgagtgatgacctgtgtgttgggaatggttgtcagaagagaacgggaaatccgtagttttgtgaagacaccattttatcgggttgtggcttcattggagacagaagatggagtcggaaaatttgatggagaatggcgtgcggtaaaaggcagccggtattttgaatctccaaaactttataaagaaaatggtttcaaagagaaaaaagatgccgaagagctggtagggattttatcgacggaatcaccttgtcaggctgtgattgaaaaaattgaacgtaaaaaagaaaataaaaatccgccgtttttatttaaccttgcagaacttcaaaatgagtgttccagattgtttaaaatcagtccggatgaaacgcttaaaatcgtgcaggaattgtatgagaaaaaactggtcacttatccgagaacagatgcccgtgtgctgtctacagcagttgcaaaagaaatttataaaaatcttcgaggacttcaaagttataccaaggctggagaatttgcaacagaaattttaaatcagggcagttataaaggaattgcaaagacaagatatgtcaatgacaaacagattaccgaccattatgcaattataccgaccggacaggcaatgaatgcgctaagaagtctttctctggcttcagaaaacgtttatgaaacgattgtacgcagatttttaagtgttttctatccacccgcagtttaccaaaaagtcagtctgatatccgttacaaaagaagaacggctgttttcttcatttcggattctgatagaggaaggttacttgaaagtaacacaaaattcctttgccaaaaagaaggcagaaaaagtggaaacggatgcaaaagaaggcgagcagatggaagataagacatttttaagtgttcttcagagtctgaaaaaaggaagcattttgcaggtaaaaggctatcagattaaagagggggaaacatctcctccgaaacgttatacttccggttcgatgatactggcaatggaaaacgcaggtcagttaattgaagatgaagaactgcgtgcccagataaagggaagcggaattggaacaagtgccacaagagcagagattttaaagaaattaatgatgatttcttatctttctttaaataaaaagacgcaggtgattacgccgactcagcttggggaaatgatttttgatgtcgttaatgtctcaattcgaccgctgttaaatccagagttgactgcaagctgggaaaaagggctgacgtttgtggcagagggacagattacaccggatgaatacatgcagaaacttgaacaatttattacagtgagaaccaatgcggtacttggacttagaaatcagttcgccctcagaagattttttgatgaggcatcggtttattatcagtcaggaaaaaagaaaagccagaaaaaggagaaaacaaatggaacagttaaaaatcagtgaattgtatcaggatttaaatcagacactcgcaaaagaattattagaaagcaagacgtatccatgggaagtactgcctctgattagcgaatttattgtaaaacttggcagtaccttaagtgaggaagaatatgaaaaacgtggagaaaatgtctgggtggcaaaatctgcaaaagtagcaccaactgcatttatcaatggaccggcgattatcggaaaagaggcagaagttcgtcactgcgcttttattcgcggaaatgcattagtgggagagggagcagtggttggaaattctacagagttaaaaaatgtaattttatttaataaggtacaagttccacattataactatgtaggagattctatcttaggatataaatcccatatgggcgcaggttcgattacctctaatgtgaaatctgacaagaagctggttattgtaaaagcaaaagatacgcagattgaaaccgggctgaaaaagttcggtgcaatgcttggtgatgaagtggaagttggatgtggttctgtcttaaatccaggaacagtagtgggaagtcattctaacgtttatccactttcttctgtacgaggtgttgttccggcaaacagtatttataaaaacaaaaatgaagtagttgaaaaacagtaagatgtactcttggaattttccgaggatgaattaaaaacgaaaagaggtttttatggaatggaaattttctaaaaaacagctgttgcctccggttttatcaggaagtacattaaaatggattgcaattgtaacgatgctgattgaccatatcggagctgttttatttgaaaacggatttatcaaagcctataatcagcagctttcgggcgcattttcttattctgtcactcatgcagtctggtatgcagacatctggatgagacgaattgggagagttgcatttccaattttttgctttttattagtagaaggttttttccatacatcgaatcgaaaaaaatatgcacttcgtctgggaatctttgcacttgtgtcagaggttccctttgatttagcgtttcgcagttcgattttggagtttacctatcaaaatgtaatggtgacgttgttcatcggatttttgacaatttgggcgatggaggtactgcgccggaaaaatccggcatggatggctgttgcagcaggacttggagtgttgaccggatatctggcaaggagtgattatggctggaagggaattattttaattctgattttttatttattttattatcagcccgtggaaaaaacgattgcaggctgtctggcacttttatgggaagcacccgcttgttttgcctttttgtcaattaatttatataaccatcaaagagggagaggacactctttcaaatactttttctactggttttatccggttcatattttggttttagttggaatccggtatgggctgtttggaatctgataaagtctaagagaaatcggtaggtatgtaaaaacttcaatggctatgagaaatccagaatatttccttgtgtagtattgctgagacgtgtataataaatacataaaaattagtagaaatcaccaaaggagagagcgccatgtggattttaagattcaaacctgtggattgtaaaaactgttataaatgtgtcagaaattgtccggtaaaagcaattcgggtaaaaaatcatcaggctcagattatgcaggatgcctgtattttatgtgaaaaatgcaccattgtctgtccccagcacgcaaaggctgagaaaaatgatgttccaagtttaaagagaatgattgcggagggaagagagcttgtagcaagtgtaaactctgcttatattgcaaagtatggagccggaagttttccttctcttagaaaagctctgttagagctgggattttcagatgtacgtgaaggtgcagagggagcttatctggtgaaacgagaatatgaaaggttgcttgaagagggagagaaggatgttatgattagctctatctgtccgtcggttgtccgtttggttaagattcattatccagaattgatggattccctgctttccgtattatcgccaatgcaggcacatggaaaatatttaaaagagcagaatcgagaatgtacgcttgtctatatcagtccatgtatttctccgattgcagaattaaatgaacagattaatgacgtgtcttatgttatttcatttgatgaattagatgactggcttgcagaaaatcagatgtgtatcgaagatgagaaagagaatgtagaaccgcgattgtcccgtatgcgtgcgcttgggggaggtatgagccggattatgaaaaaaaatccgaaatacagctatatgaacatagaaggaatcgataactgtattcgggttttaaatgaattaaaagaagggaatatccatcattgctttttggaattaaatgcctgcgatgggggctgtatcggtggaccgtctttccagacaagtaaagtctgccggcttcagagtcagcttgaactggaaaaagcttcgatttccgatgcctcaaatatagaaaacggcaaagattttgatatttccgaaaaaattaatatgagccgtgggattattggacgagttgtggaggaatcgtatccaacggaagaagaactgcatgaaattctggtaaaaatgggcaagacaagtccgttaaaggaattaaactgcggagcgtgtggttacaatacctgccgtgaaaaagcgattgcgattttccagaataaggcagaggtttcgatgtgtatgccttatatgagagagcgcgaagccagttatgcgaataagattatcaatgcgatgcctggtatgcttgtgacagtaaatacagaattaaacgtcatccaattaaataaagcagcaatggacttatttgatatccgaagaaagaaatctattatcggacagcctgtcagtgaattgatggatgactatgcttttgtaaatatgctgtcttatggaaaaacattctcacaggaccagatttttgtagaagaatttaaggtttatttagaccgtgtgctgacttatgataaaagcaatggtctgattatctgtattatgaaaaatgtaacaaaagaaattgcacagcagcaggaaattcaaagaacccgcattgtggcagcaaggatggcagacaaactggcagatgagcagcttcggattgtacataagattgcggaattgttaggagaaacagcggcagataccaaggttgccgtagaaaacttaaaagagacaattcttgcggagaaaaaagaagagaaacgtgaaaaaccggaggtttggttatgagagtgtattttgacaatctgtttgcggattttgcccatgtcagcctaaataagaaaaaagaatcgttgtgtggagatttttacatcatggaagaaagagggtctgataccgttttagtactctctgacggacttggaagcggtgtaaaagcaaatatcttagcaacattgacggcaaaaatgctttgtacgatgatgataaagaaaattcatctggaagaagcggtaaaaacgattgcagaagcacttccggtgtgtcacgaaagacagcttgcttatgctacatttcttgctatgaagattacaggaagacatgtttatcttgcgacctacgataatccgggactgattttgcttcgcaaaggaaaggtatttcattacgaagagaaaattcatttgattaacgagaaggaaattcgtgaagcagagtttgacttacaaaaagacgacatgctgattttgatgtcagatggtgtaacgaatgccggaatggggaagacaaccgatggaggctggggatatgaagaggttgaaaaattttgtgaacagaagtataaaccgaatctgagcgctcagcgtatggcggttgatattgcagaagcctgtgtggatttgaatttaaatgagacagatgacgatattacggtgcttacaatccgtctttgcgaaccgttagttacgaatctgatgattggccctccaagtaaaatggaaaaagacgaggattttttaagagtcttttttgaagaagaagggcaacatatagtgtgtggtggaacgactgcaaaatttgtggcaaactatctgggagaagaagtcgtaaccattaaggggtcagaaacagatgcagttccggcgatgtctgccttaaaaggggttgatatggtaacagaaggttatttgactttaaaacagcttgttacctattcaaaccgatggctgtctgacagtatggcggtgataagtatctcaaaacaaaaagatgcagctgcaaaactggcagtggaattatttgaacgttcttccgaaatcaatattttctttggaaatgcaagaaatccagcttataaagaactgaatattgattcgagtgaaaagcttcggctgacttataaattaaaagaacatttggagcgggcaggaaaaaaagtccgtatgaatatctggtaaaaaagaaaagtatctgtataggacaaaaaatcaaaaaagtccctgcagatacttttctggtttatcagaaaaaagttttgtcattctatagaaaccagaattaggattttgggaaaaagaaggacaataaaattttaattgcatagataatcaatagaaattaataaaaaattgaaaaattaataaaaaaattgaaaaatatagcagaaaaaaagtgttttaaagattaagtttgtgcaccaatcttgctgaaaatatagtataatagcccatatagaaaggggtgggcaaaatgacacgagaagaaaaattacaacgtgcgtctcaaatcatcaaagaaagtaaatatctggtgtgcctccttgggatgagggtgagttatcaaagtggatgtacgaacataggggagccggaggatgcttatgatatcgagagtcgatatgggtattctccagaagaattgtttagtgcagtgttttacaacaccagaccatctcagttttatgaattttataaaaatgaagttctcagcaaaagaggtagaataaatgagggtttaaaactgcttggtcaactggaagagatgggaattttaaaatcaattgtaacaagagacatttactctttgccaaaacgtgcaggatgtaaaaatgtactggaaatccatggaagcatttatcgaaatatttgtccaagatgcaggaaaaaatatccgttgaaagctttgcaggaaagagaaagaagtggacttccatattgtgaaaagtgcggttcgattatccgtccggaaatttacctaaaaggggagatgatagataatcgtctgcttacaaaagcagtagatgaggtttcaaatgcagatgttctgttgatgctgggctgctcgatgcgttctgacctgggaagtatgtttacgaagtactttaagggggaaaagattattctgatgaatgaccaggatcattttgcagatggaaaggcagatttggttatcgatggaaaagcgatggatttgatgaaaggacttagaacttacatggtctcggatagttgaatttaagcaggaagatcggttacttacagtcgagtagttcacatgggcatgcgcttgcataaatgaaaaacattacataaaaaaataaaaaaagaaatactttacaaagtgtaatgcaggagatataataaggaatgtattttgattatctggaggagatagagatatgatagagaaaaagatggaattattagaagaagaaaatgaccgtttaaaaaaagagatagaaaatttaagagaagcttgtaaagttcaggaacagacaatttcaaagttatggaatgcttatgttcagttagaagagaaagtaaatgataagtaaaaatcaataagcagagaacagaaataaaaaaaggttatcaccgcagaagtacggtggtaaccttttttgttagataaaaatccttaattttaaaggagttcttagaatttaccagctttagcagcttcctcaacggctacagctacggctacagtcataccaaccattgggttgttaccggcaccgattaatcccatcatttctacgtgagccggtacagaagaagaaccagcaaactgagcatcagaatgcatacgtccaagtgtatcagtcataccgtaagaagcaggacctgctgccatgttgtctgggtgaagagtacgtcctgtaccaccgccagaagcaacggagaagtattttttaccagcttcgatacgttcttttttgtaagtacctgcaactggatgctggaatcttgtcgggttagtggagttacctgtgatagaaacatcaacgtcttctttccacatgatagcaacaccttcacgaacatcatttgcaccgtagcagttaacttttgcacgaagtcctgtagaataaggttttctgaatacttcttttaattcgcctgtatagtaatcatattctgtttcaacataagtaaatccgttgatacgtgcaataatctgagcagcatcttttccaagaccgtttaagataacacgcagaggctctttacgaactttgtttgctttttcagcgataccgatagcaccttcagcagcagcgaaagattcgtgaccagctaagaatgcgaaacattttgtatcttcttcaagaagcatttttcctaagttaccatgtccaagacctactttacgctggtcagcaacagaaccaggaatacagaaagactgaagaccttcgccgattgcagcagcagcgtcagcagcttttctgcagccttttttgattgcgatagcagcgcctactgtgtaagcccatttagcattttcgaagcagataggctgaatgccttctaccattttgtaaacatcaagacctgcagcttttgttacttctgcagcttcttcaatggtattgataccgtatttgttcagagcagcaagaacttgcttctctcttctttcatatgattcaaataaagccattaatttatcctcctattctttctatgacagtcgcagtgataaaaataaattatgtaatcagtcgtcagaaattattcttttcttgggtcgatgattctcactgcatcgtcaacacggccatactgtccctgagctttttcaaatgcagtatttgcatcatcaccagctttgatgaagtccatcattttaccgaagttgatgaatttgtatccaatgatttcatcatcttcgtcaagagcaacacctgttacataaccgtctgtcatttccagataacgaggtccttttgcaagagttccgtacatagtaccaacctgagaacgaagacctttacctaaatcttcaagaccggcaccgattgtcagaccattttcagagaaagcactctggcttcttccgtatacaatctgtaagaacagttctctcatagctgtgttaattgcatcacatacaaggtctgtgttaagagcttcaagaattgttcttcctggtaaaatttcagatgccatagctgcagaatgagtcataccggaacatccgattgtttcaactaaagcttcctgaataataccatcttttacatttaaggttaatttacatgtaccctgctgaggagcacaccagcctataccatgagtaaaacctgagatgtctttgatttcttttgcttttacccattttgcttcttctgggattggagctgcgccgtggtttacaccctgatgtaccggacacattgtttctacttcgtgtgaataaatcattttaaaactcctttcaagaatatataattcaagtgcgttagaaatttaacgtcctattcttcattattgtctcataaaaagataaaaaaatccagatctatttcaaaaaaaattgaatccagaaaatttaaacaatgaaaatggtaacatagttgagtttggaaaataaaaatggtatgatgaaaataaaataaaactgcataaaaaaggcagagaaagaaggcaaaaatgagagtggcaaactattgggagggaaagcattatgcatttttctgtaataaagaatgtgaattttttccatgtcatcagacgaaacatccggaaaaattcaattgtctgttctgttattgtcccctgtacgcattaggagataaatgtggaggaaatttccagtttacgagagatggaatcaaagactgcagtaactgtgcgcttccgcataatccggataattatggatatataaccggaaaatatcaggaaattatggaaattgtaaagcagaatgcggatttaaaagaagaaaaataagaaaaacaggttacaaaaaccaaaatgattgatggaagaaataagatggtttggacttccaaaatttcgtatatcaaggtataataggacaacagaaaaatgtaaaacactgtctctcaagaagaaacagagacggtaaaaaataagatgtatgaaagaaaatgggagggcaaagatgtatcaggcattactttttgatttggatggaacattgacagcatcaggagagggaattacaaaatccattcagtatgcattaagaaaaatggggtatgaatctcttgcggaagatttgaaaaaattagaagtttttgttggaccaccgcttttagaacagttaatggaatactgtcagattgaggaaccggaagcagaacagggcgttgcctactatagagaacgttacaatgtggttggatattatgagaataaaccttataaggggattcgcaagcttctgccaaaattaaagaaaaaaggctacaaactggcagttgcttcttccaaaccacagggaatggtagatgcagtgcttgaacactttgaactcaatgaatattttgatgtcatcgagggtagtgatgtcaattttccaagaatgacaaaatcagatgtgattgaaattgcactaaaaaaactaggattttttgaagcagaaaaacgaaaaggtgttgtcatgattggtgacagaaaatatgatgtggctggtgcgacggcgtctcggcttgattgtattggagtcgcttatggatatggcggaacagaagaattagaatcagcaggtgcgataaaggtagtacagacggtagaagaactcggagaatttttgggagtcagtaaaaaagccagattccatgatattggaaaagagttattttccacaccggtttatccgggagacccggcaccgtcaaaaactccattctatgaaattaaaaagggagatgactgtaatcttaccattctttcttttggaagtcataatggaacacacttagatgcaccgaaacatttctgtgaaggcaaacatggagttgaccagattccacttgaaaaatgtctgggtgaatgtaaagtgataaaagctgagggtgtaatcggaaaagaagagatggaagctttattagcagatggtacaaagaagcttttaatcaaaggagaaattcttctgacaccggaaagtgcaaaagtatgcgtagaggccggactggatttgattggagtagaaagtcagaccgttggaggaaaaggaacgcaaaaagcggtgcatcagactttactttcagctgaaattgtaattttagaagggttagtgttaggagaagtgacacaaggaacgtattttttaagtgctctgccgatgaaaatggaagggcttgatggctctccggtcagaccggtattgattgagtattaagaagaaaaaagagctatctctgataggtaaaaaaataaccggacgggttttcctgtccggtttgtatgttaaggtttaaagttcagctaataaaatcgcagcgaacataaggacacagccaatcaactcccgtgtgcttaaagtctgatgtaaaatcacccatccggcaaggacagagatgacagattccagacttaaaattaaagaggcaatggttggatttaaatttctctggccgataatctgtagggtataagcaacaccgcaggaaaggattccggcgtataaaatcggtgcccaggctgcacagatactggaaagctttggattttccagcacgaacattggaatcgcagataacattgaggcaataaaaagctggatacaggagagtttgactccgcttactttagaggaaaagtaatcaactactaaaatgtgaaaagagaaaaataaggcaccaagaagtatcagggcatctcctttggtaagtgtaagacttccactcatacataacagataaagaccaacaagggcaatcaatacactaatccagatttttaaatttacttttcgtttcaaaaagatacccagaatcggaacgatcacgatataaagtgcggtaataaatccggcttttccgactgaagtatataaaattccgatttgttgcaaagaagtcgcaataaaaaacagaataccacaggagatacctccaagaatgctctcttttggtcggtcatgcaaagtatctttgtcaactttttttgcagtacgtttttggttccagaagataacaggaattaaaatgaaactgccaacaaaacaacggacagcattaaaagtaaaaggaccgacgtagtccattccaacactttgggcgacaaaagcaacgccccagataaaagcggcgagaaataaaagcagagagcttttgaaagatttagttttcataatagaaaaactccttcatatttgtatagtttgtatagattatagcattcaaaaaagtaaactgcaattacagaataaaagatagagaaaatagaggagaaaaaagaaatgatagcaaataaagaagagattagagttgggcaggttattgtacacatcttagattctaccgttgggatgcctgtgctttctgacacagtattagattatggttcagactttgctgattttataaaagcacatatctttaaaacagataacagtgatgatatcagaagatgcgtatttgaagaagagtctgcaatttatagttatcttcaagaatggaacagtgaaaattttgtagatctctcaaaaaaaatagcggaagaattatttacgattatgaatcagaatattgaaattccacaggccgatttaataatagcagaatatgaattggaaaaacgaaaatatcttgcaattttaaaaatggattataagagtttttacactcatttgaccaattcggatccgtggggaaataataatgagattatcagacaaaaagcgattttgccaggggaaaaccagaaactttcagaggcagctctcctcgattttgaagcccctcaatatgtgcgtttgaccgaaaagaagtatgagataaatggtgtcaaatcctattatttttcaaagttattcttaaaatgcaaggcatcgctttccgcaaaaagccggttaaatcttgtcagcaaagcagtatccgaggttcagaaaaaattttatcatgaatcggaacagtttgaagtccagatggagacaaagagtattattaatgaagagttttctaaagatggagtacttgatgtaccggttgtaatggataaaatttttaaagaacatcctaatatgagaaaagaagttgaagaaaaattagagaaatacaatcttgcaaatacaactgtagagccgcaaaatccgacaacgacgaaaaaatttaccaaacagcatctgatgacggacacgggtattgaattgaaaattcccatggaagaatataacaataaagacagaatagagtttattaccaattcggatgggacgatttccgtgttaattaaaaatatcggctgcattgaaagtaagtagaaaacatgatataatatattgttttcagtcaaaaaagaaaagtaggaggttttactgaatatgaaacgagaaaagttttcttccagactcggatttattctgatttcggcaggatgtgcaatcgggcttggaaacgtatggcgttttccatatatttcgggaaaatatggcggagcggcattcgtactgatttacttattctttcttgcaattttaggactgccgatcatggttatggaatttgcagtcggacgtgcaagtcagaaaagtattgcaacttcctttaatgtacttgagaaaaagggaagtaagtggcatgtttaccgttattttggtatggcgggaaattatctgttaatgatgttttatacaaccatcggaggctggatgcttcagtatttctttaagatggcaaaaggtgattttgtcggattaaatgcagaacaaatcagcagggtatttggagaggtttccacaagcaaaaacagcatgattttctggatgtttgtgattgttgtacttggatttttagtctgctctcttggactgcaaaatggtgtagagaagattactaaagtcatgatggtagtgcttctggcattgatgttggtgctggcagtccgctcctgtacgttagatggtgcatcagagggattaaagttctacttgcttccggattttaagaagctgacagaatataatgtcacagaagttgtatttgcagcgatggggcaggcgttctttactttaagccttggaatcggtgcacttgcaatttttggaagctatattggaaaagaaagaaaactgaccggagaagctatcagtattacaattttggatacctttgttgcaattgttgcgggattgattattttcccggcctgttttgcttttggcgtagaccctggagaaggaccgggactggtatttgtaactctgccaaacgtatttaacgcaatggcaggtggaagagtctggggaacattcttctttttatttatgacatttgcagcgttatctacaatcattgcagtattccagaatatcattgcatttgcacaagatttatggggatgggggcttaaaaaggcaagttttgtcaatatgattgcagtatttgttttatccctgccatgtatctttggaatgaccatctggagtgactttacgattcttggaaaagatattatgggatttgaagatttcctggtaagtaataatttattaccacttggttctttagtttatctgatgttttgtgtctctcgttatggatggggatgggacaacttcttaaaagaagcaaatacaggagcaggaatttctttcccgaaaaaaattcgtttttatctgaactatattctgccgttgattgtactgtatatctttttccagggatactggagtctgtttcagagtttatagaaaaattccttgaaatcgcttaagtttacaggtatacttaggtcaggatatgcaaaaaggcagatttaagaagatttaagaatggaagaaatccttaaaactgtcggaataaaaaattaggaaatacaagaggaaaaaccatgaagagaattttattaaaattaagcggagaagcacttgcaggtccaaaaaaaacaggatttgacgaagcaacagttatggaagtggcacgtcaggtaaagactttggtggacgagggaattcaggttggaatcgtaattggaggcggtaatttctggagaggccgtaccagcgaaaatatcgaccgtacaaaagcagaccagattggtatgctggcaactgttatgaattgtatttatgtgtcagaaattttccgtgcagcaggaatgaagacaaatgtactgactccgtttgaatgtggttcttttacaaaattattctcaaaagaccgtgcaaacaaatattttgaaaaaaatatggttgtttttatggcaggtggtaccggacatccgtatttttcaacggatacagcaactgtacttcgtgcaattgaaattgaagcagagactatcttccttgcaaaagcaattgatggtgtttatgacagcgacccgaaaacaaatccggatgcaaagaaatatgatgaagtcagcattgatgaagtcatcgcaaagaatttacaggttgtagatatgaccgcttctattttatgcagagacaataaaatgccgatgctggtatttggtttaaatgaaaaagacagtattgtaaatactgctcatggaatctttacaggaacaaaagtattggtataaaagcaggagggattttttaatatggcagacgaaagaattgaaaaatatgaaagcaagatgacaaagactcttgagagtctggaaaaagaactgtccacagttcgtgcaggacgtgcaaatccgcatatcttagataaaatcacagtagactattatggagcaccaactccacttcagcaggtagcaaatgttacagtaccggaagcaagaatgatacagattcagccttgggaagcatctttaatcaaggaaattcagaaagcgatcctttcttctgatttaggcttaaatccaaatacagatggaaaaataattcgtctggtattaccggagctgacagaggaacgaagaaaagaactggtaaaagatgtaaagaaaaaaggggaagctgcaaaagttgcagtccgcaatatcagaagagatgccaacgatgcgtataagaaactggcaaaacaggatgtgtctgaggatgaaatcaaagaactggaagacaaaatccagaaactcacagacaagtttgtgaaaaatattgacaaagcagtagaagaaaaatcaaaagagattttaactgtataagctgtataaaacagagggggcacatacatattacgtattgtgccccttttatgcgtaggaggaaaaaatggtaataccgaatcatgtggcaattattctggatggaaacggacgttgggcaaaaaagaaagggatgccaagaacgtatgggcatgtcaaaggctgtgaaaatctggaaaaaatctgttctgttgcaaaagaactaggagtaaaatatctgaccgtatatgcattttctacggagaactggaaacgatccaaagaagaggtggatgcgctgatgaaattattccgtaattatatgaaaaagtgcattaaaatttcaagggataataagatgcaggtacgtgtcattggagatccgacagcatttgaccctgatttacaggaaaaaattaaagagttagaagaatattccagtcagtacgatgaattatattttcagattgctttaaactatggaagccgtgatgaaattaaaagagcggtacagaagatggcagaggatgtaaaagcagaaaagttaaatccggaagaaatttcggaacggacgatttctgattatcttgacacgaaaggacttcctgacccggatttgttaatccgcaccagtggagaagagcgtctttcaaactttttaatgtggcagcttgcctatacagaattttattttaccgatgtggcatggccggattttaataaagcagagtttgaaaaggcaattgcaaaatacaatcagagagaccgtcgttttggtggggtaaaggaggagccggcaaatgtttaagacgagactgattagcggaattattctggtcatcattgcacttgcaacgattattccgggaggtccggtgctttatgtgactttgcttgcaatttctttgattggcatgcaggaattataccgtgcgatgaaagtgcgtgagaaaaattttaattttctggaacttgcgggttatgccggtgcagtttgttattacctttctttattaaaaggtggagaactcccgcagatggcattgatgtttgcacttgtgctcttaatggctgtgtatgtattcacgtatccaacctatcatgcagaccagattatgtcggcaatgtttggaattctctatgtggcagttatgctttcttacatctataagacccgatgcttagaaggcggtggctggctggttggtctgatctttttaagctcctggggaagtgatacctgtgcatactgcgtgggaatgttgattggaaaacacaagatggctcctgttttaagtccgaaaaaatcagtagaaggcggagttggtggagtaatcggcgcagccctgcttggtgcaatttatgcactggttatctcaaattggaatggtacgtccactcatacgcctcttatgtatgccttaatctgtgcagtgggcgcactgatttccatggtaggagatttggctgcatcggcgattaagagaaataaagaaattaaagattatggaacattaattcctggacatggcggaattttagatcggtttgacagtgtaatctttaccgcaccgtttatttattttctgtccatgatacttttgtagaaaggattgaacttacatgaagaaaattgcgatattaggttcgacaggttcaataggaacgcagacgcttgatgtcatcagcaaaaaagaagatttggaagtggtcgggatttctgccggaagcaatattgagatgcttgaagcacagattcgtcggtttcatcctcttttagcagctgttggtgatgaaaaaaaagcacaagaattaaaaatcaaagtggcagatacaaactgcagggtagtcggtggaatggatggacttttggaacttgctcagatggaagagtctgatattttagtgactgcgattgtgggaatgattggaatccgtccgacaattgccggaattgaagccggaaaagacattgctctggcaaataaagagactttggtaacggcagggcatttgattataccgcttgcaaaaaaatgtaaagtgcggattcttccggtggacagtgaacacagtgcgatttttcaggcattaaacggagaagaaagcagacggattcataaattattagtgactgcttcgggcggtccgtttcgtggaaaaaaacgggaagaattggaaaatgtacaggtagaagatgccttaaagcatccaaactggtcaatgggacagaaaattacgattgattcagcaacactggtcaataaagggttagaagtaatggaagcaaaatggctgtttggagttccggttgaacagattcaggttgtcgttcagccacaaagcgtgattcattcaatggtggaatttgaagatggtgcagttatggcacagcttggaaccgcagatatgcgtctgccaatccagtatgccttatatggcggagaacgtcgctttttagatggagaacgtctggattttgcagcattaaaatcaattacatttgaagaacctgatatgaaaaccttccgtgggcttccacttgcaatcaaagcatcgaaaattggcggttctatgccgacggtgtttaatgcggcaaatgaaaaagcggttggaatgtttttgaaaaagcagattcgttttcttgacatttattcaattattgaagaaaccatgcagacacatactgtaattgagcgaccggatgtagagacaattacggaattagagcaggatgtatatagacagattggaggcagatggtaagttgtcgaagctattaaatatactcgtcgcgattattatcttttctgtgattgtagtgttccacgaattaggacattttcttctggctaagaaaaatggaattgaggtaactgaattttctcttggaatgggtccacgtcttttatcgacggtaaaaggaaatacacgctattctctaaaactatttccaattggcggttcctgcatgatggtaggagaagacggagaagaagatggaccaggttcttttgggcatgcatctgtctggggacgaatcagtgtagttgcagccggaccaatatttaattttattcttgcatttgtgtttgcattggtcattacgagtgtgatgggatatgacccgccaaaggtactttcggtggaagaaaattctccggccgaagaggcaggattacaagtgggagatatcattacgagttttcaggggaaacctatttccatcggcagggatatcagtttgtatgaatctctttatggaatgcagcaggatcagattaagatgactgtaaaaagagacggaaaaaagattgatttaaattttaaagctgcaagtgaaaagaaatatatgttaggcttttcttatgttccggatggagaaccggaaattacggaagtctttgtcgatggagcgatgatgaaagccggagtgcttgcaggagatgtgattaccgcagtagatggaacgaaagtttcgacaggagaagaacttcagacgtatctgggagagcatccgcttggagagaatgctgtgacgattacggtttcgagagatggaaaagagaaagaatttacggttcaaccaacggtacggacacaggtcagcactggatttgtctataatctgtatcgggaaaagacaaatttctttggtgtgttaaaatacagtgcagtggaagtccgatattggatttcaagtacgattgacagtttgggactactaatcaaggggacgtttcgtgtcaacgacctgtcaggtccggtcggaattgtagatgcaatcggaagttccgtagaagaggcaaaatcagagggaaccgttgtgatgtggatgcagatgttctactgggcaattctgttatctgcaaacttaggtgtcatgaatcttcttccgcttccggcacttgatgggggacgactggtatttttactgattgaggcggtaacgaaaaagaaagtcaatccgaatatcgagggaatgattcattttgccggatttgtacttttaatggctttgatggtttttgtatttatgaatgatataaaacgtttataatggaaagaaaaatggtttgaggttttgaccttgaaccattttttcacgttttgggaaagagaggcatatcttaaagcgatgagccttttgaggtgttttatgcgaagaaacggactaagagcaatgcaaaatgaccagattgataaaggcggtcttaagatttcagttgtttcgtcgaacagaaatcgtccaattgcaaatgcgaggattgaaatcacttatacaggagacccggagaggattgtagagcgtctgataacagatgaaaatggtcagattcctgaaattgaattgtcagcaccgccgattgagtacagtatgacgccgtctgagtatcagccgtattccgagtatgattttcggattacggcggatgagtttgaaccaattacaatttcaggtgcagaaattctgcctgagattactgcacttcaaacgataaaactcaatgagagaagtataagagaaccatttgaggttattacaattccagaccataccctgtatggaaattatccaccgaagattccggaagatgagattaaaccggtggatgaaagtggagaaattgttttaagcagggtcgtaataccggaatttattgtggtacatgatggttcaccggaagactctacggcaaatgattactatgtgcgatatcgggattatattaaaaatgtagcttcgagtgaaatttatgcgacctggccgagagaaacgattaaggcaaatgtactggcaattatgtcatttactttaaatcgggtgtatacagaatggtatcgaaacaggggatatgattttacgattacttcctctacagcgtttgatcataaatggatttttggaagaaatatttttgatacgatttcagaagtggtagatgaaatcttttcgtcttacctgtcacggccgggagtacgtcagccgattctgactcagtactgtgatggggaacgggtttcgtgtcctggctggatgacccagtggggcagtaaatatcttggggatggagggtattcggccattcagattcttagaaatttctatggaagtaatctgtacattaatacagcagaggaaatctcagggattccgctttcctggccgggatatgatttggatatcggggcttccggagataaggtgtcacagattcaggaacagttaaatgcaatccgtgaggggtatccggcactgccgaaggttcgggtagatggaatttatggagaaggaacacaaagagctgttcgggaatttcagagaatctttgggcttccggtgacaggaatcattgactatccaacctggtatcggattcaggatatttatgttggagtgacaaggattgcagaattagtataattggttgaattgtttgaattgccaatatataaaaagaaattatttaaagattccattaaaagataaaatatttcaaaaagaaagataaattattcacaaatacagtatggataagccataaaatatgttgcataatgaaggggagaaaggatacggtaaatggattggaaaaaggagaagataaatttatgaaagaacaggataaaagattacaggatttaggggtacagatttcaatttatcggaaacagaaaaagatgacacaggcacagttagcagtagagattggtattagccggacacatatgagtaacattgaggcattgaatatgccgactcagatttcggtggatacattatttaagattgcggatgtactgggaattaaagtttctaatttgtttgaagagatttaaataaataatggggtatgatatgagtcagtaaagtgggcattcgcaatccgcttatctgcatttggaaaaattctatatgaatcagagtagaacaggaatgtctactttacaaactgatgaaaaagcgatagaataagaccagatgaaaataaaaaagaacagggaaaaaggctgtcaggctaaaagaactcttttggcaggacagcttctttttttcaggcagatggaggatgcatgtatggcaaagtatatgatggcgctggatgctggaacaaccagcaaccgctgtattctttttaatgaaaagggggaaaaagtcagtctggcacagaaagaatttacccagtattttccaaaaccaggctgggtggaacatgatgcaaatgaaatctggtcaagccagcttggagttgcggtagaagcaatgcagaaaatcggggcgacggcttcagatattgcgggaattggaattaccaatcaaagagagacggcgattgtatgggataaaaagagtggagaaccggtttatcatgcaattgtatggcagtgcagacgaacttctcagtattgtgattccttaaaaaagaaaggactcaccgaaacatttcgccaaaaaaccggtttgattgtggatgcgtatttttcaggaacgaaaattaaatggattctggaccatgtagagggagcaagagagaaagcagaaaagggagaactgctttttggaacagtggagacctggctgatttggaaactgacaaagggggcagtgcatgttacggattattccaatgcttcaagaaccctgctttataatatcaatgaattaaaatgggatgaggagattttagaagaactccagattccgcgcagtatgcttccggaagtaaagccatcaagctatatttacggaaagacagatgcaagttttcttgggggagaaattccaatcgccggggcagcaggtgaccagcagtcggcactgtttggacagacttgttttaataaaggagaagcaaaaaacacttatggaacaggatgttttttattgatgaataccggagaaaaaccagtcttttctaaaaatggactggttacaaccattgcctggggactggatggaaaagtaaattatgcgcttgagggttcggtgtttgtcgcaggagcagcaattcagtggcttcgggatgaattaaagattattgacagttcagaagattcggaatacatggcaaaaaaagtggaagataccaacggctgctatgttgttccggcatttactggtctgggtgcgccatactgggaccagtatgcgagaggtacgattgtggggctgacaaggggtgtaaataaatatcatattattcgtgctacattggaatccatcgcttatcaggtgtgcgatgtcgtaaaagcaatggaagcagattcaggaatttcgctttcttctttaaaagtagatggtggagcgagcgccaatgattttttgatgcagacacaggcagatatcgttcaggttccggtaaaacgtccaagctgtgttgagacaactgcaatgggagctgcctatcttgcaggacttgcagtcggatactggaaaaacagagaagagattattaaaaactgggaagtggaacaaagctttgaaccggttttagaaaaagaagagcgggataagaagatgaaaggctgggagcgtgcagtgacctgttcttacggttgggcaaaagaggatgatgaaaatgagtgaagaaaatctggaagtaccgtttgaatttggcgaatgtcatgcccatatttttatggatgggaaaaattataaaaaggcagtggaacgtcataaaaacggagtagatgaatcggtaatccgcagtcattttgcatgttatcaaacacagggaattcattttgtgagagacggaggtgacgctcttggcgtttcaagacgagcaaaagagctggcaccggaatacggaattgattatcggacaccgatttttgcgattcataaaaatggtcattatgggaaaattgtcggaaaaggatttgataccttaaaagaatatacggctttggttaaggaagtaaaaacacagggcggagattttattaaaatcatgacaaccggaattatggattttgacaccgatggcggaattaccggagaagctttaagagcacaggaagtcaaagagatggttcatattgctcacgaagagggatttgctgtgatgtgtcatacaaacggtacaaaagcagtggaggcactcatagaagccggagcagacagtgtggaacatggaaattatatggaggagcagacaataaagagtctggctgattccgatctggtctgggtaccgacagttacagttgttccaaatatgtttggatgcgggcggttttcggatgagcttctgcataaaatttatgaaaaagaaaaaacgaatatcaaaaaaggacttcagtatggagtaaagatggcacttggcagtgatgccggtgcatatctggtgttccatggtcagggaattttagatgaatatgcaagatttctggaatgcagaaaagaaattcaagaagagagtcaggaaaatgaacaagaattcctgtcggtttgtgagttaaaagcaaggctgaaagctggagaagcagaaattagaaaaaaattcaaaaaaatcgaaaaaagttattgacgaaataaaactttggtgatatacttctgtttgtcgcttgatgaggacggcaaatgagaagcgggagtgctggaattggcagacaggctagactaaggatctagtggtcgaaaggtcgtgtgggttcaagtcccatctcccgcataacagaggcggaaaacttttagagataaaggttttccgcttttcgttttatataaataatattgtgatgtaagaaaaagtgcatctttctttttatgaaaaatacattgattcgtgaatttattgcaaaaaacgataataaatgatgttatcagaaaaaaataaagtttttttcaaaaatatgttgacaaaacacgaaattactgatatacttctgattgtcgcttgataagggcgataaatgagaagcgggagtgctggaattggcagacaggctagactaaggatctagtggtcgaaaggtcgtgtgggttcaagtcccatctcccgcataacagaaacggaaaagctattagagataaaagcttttccgttttttcgtataatcaggaagacagtttttcgataaaagaagaaagtgagaattaagaaaaaaatatcgaaaaacaaaaggattttacagatttgcctgtaataattaatatgagacaactttttttccacagagagggtgatagatcgtgacaatacgagaagaagcgcaactggaagaggaaagaattttaagtccttatgcagcaaaaagtgcaaaaagcagaggacgggaaacttatgaggaagaatgtgatatccggaccatgtatcaacgtgacagggaccggataattcattctaaagcatttcgcagactgaaagataaaactcaggtgtttttagcaccgcaaggggatcattaccggaatcggctgacacatacaattgaagtatctcagattgcaagaaccattgcgaaagcacttcgtttaaatgaagatttagtggaagccattgcactcggacatgatttggggcatactccatttggtcatgcgggagagcgagccttagaccaggtgtgtccccttggatttgcgcattataaacaaagtgtgcggattgcagagcgtctggaacgaggtgggaagggattaaatcttacctttgaagtcaaagatggaatgatgaatcacaggacaagcggaacaccgcatacgctagaaggacaggtcgttcggattagtgataagatttcctatattcatcatgatatggatgatgccaagcgtgccggagttatcaccgaagaggcagtaccaaagtatttgagggaacttcttggagagacgacaaaggaacggctcaatacgttgattcatgatattgtaaagaacagcaaaggcagggatgaggtcctgctgtcaccggaaattgaagcaggaatgaaagcacttcgagagtttatgtttgaagaggtttatctaagtcctgtggcaaaagaagaagaggagaaagcagagcagttagtggagactctgtataaatattatgtaagaaatcctgaaaaaatgtcggcagagtatcgaaagcttctgaaagaaggagaagtgcaggagcgggtagcctgcgattatatttcaggaatgacagaccagtactcgatggaaaaattcagggaaatttttattcctaaaggatggagcgtttattaattatgtattattcggatgatgtgattgaagaagtccgtatgaaaaatgatattgtggatgtgatctcaggatatgtcagacttcagagaaaaggaagttcctattttggattatgtccgtttcataatgaaaaatccccttccttttcggttagcccatccaaacagatgtattactgctttggatgcggagccggaggcaatgtgtttaatttcattatggaatatgaaaattttacctttattgaggcagtaaaatatcttgcagacagagccggagtcaagcttccggaacaggagtattcaaaagaagcaagggcagcggcagatttaaagatcattctgcttgaggtaaacaaaaaagcagctgcttattattactatcagctgagacaggaaacagggaaaaaagcactggaatatctgcagaaacgagaattatcagaagaaacgataaaagcgtttgggcttggatataccgggaattattcagatggtctgtatcggtatttaaaatcaaaggggtattctgaccagattttaaaagaggcagggcttttcttctttgacgaaagacagggaatgaaggataaattctggaatcgtgtgatgtttccgattatggatgtcaataaccgtgtgataggttttggtgggcgtgtgatgggagatgcacagccgaaatacatgaattcaccggaaacaaaaattttcgataagagtcgtaatttatatggactgaatattgcaaggcgaaccagaaaaaattatttaattatctgtgaaggctacatggatgtgatttccatgcatcaggcgggatttaccaatgcagttgcatcgctcggtacagcattaacttcggggcatgccagtctgatgagaagatatacaaaagaagtattattaacttatgacagtgatgaagccggtcagaaagctacacttagagggattccgattttaagaggagcgggacttcgaccgaaagtcgtaaatctggcaccttataaagaccctgatgaatttatcaaggcagagggtatggaagcgtttgaaaaacgacttgaaaatgcaatgaattattttctgtttgaggtacaggtcttggaaaaagagtatgattttaatgacccggaaagcaaaaccgagttctatcgcgcaattgcagaaaagttattagaatttccagaggaacttgaaagaaataactacattgaaagcatttcaaaaaaatatcagattctgccggaagatttacggagaatggtaaacaatatggcactttcgggtcggagagtgacacagccaaaagctgaaaatctgacagacagaagaaaagcaagaaaaaaagaaagtggaaaagaagcttcccaaaaactgatgttgacctggctgacttcttatccaaaaatgtttgagacaataagtggctatattacgccggatgattttacaacaccgttgtatcaggaagttgcaaagctgctgtttgcgcagtatgaagaagaacacgcagtcaatccggcaaagcttttaaaccgctttacggacagtgaagaacaaaaggaagtgacatccttatttcacgcaactttgcatttggagggagatgaagaacgcaaacaggcgattcgtgaaaccgtatgcagattgaaacgggacagcatagcctatcagacatcaaatctggcaccgacagatatgattggactgcaaaaacttttagaagccagaaaacgtctggaagaaatagaaagtggaaaaatcacactgcatatttcttttgattgaggtaaagatataaataagttatgagaggatggaacgattatggaaatgaatatggcaaaatttagcgagaaactgcacgaacttgtagagatgggcaaaaagaagaaaaatgtgctggaatacaaagaaattaatgaagtgttaaaagatatggaattagattccgatgcaatggataaactctacgaatatcttgaagcttatggaattgatgtgctgcgtattccggaaggagattccgatgatacatttcttttgagcgatgatgatgaagtaaacttaagtgaagaagacgaagtggatatggaaaatatcgacttgtctgttccggaaggtgtcagcattgaagaccctgttcgtatgtatttaaaagaaatcggtaaagttccgcttttaagtgcagaagaggaaattgaattggcaaaaagaatggaagagggagatgaagctgcaaagaaacgtcttgcagaggcaaacttaagactggtagtcagcattgcaaaacgttatgtaggacgaggcatgctgtttcttgatttgattcaggaaggaaacttaggtctgattaaagcggttgaaaagtttgattatcgtaagggctataaattctctacttatgcaacctggtggattcgtcaggcaattacaagagcaattgcagaccaggcacgtaccatccgtattccggttcatatggttgaaaccatcaataagctgattcgtgtttcacgtcagcttcttcaggaactgggaagagaaccacagccagaagaaattgcagaaagaatggatatgtccgttgaccgtgtccgtgaaattttaaaaatttctcaggagccggtatctcttgaaacaccaatcggtgaggaggaagacagtcaccttggagattttattcaggatgataatgttccggtaccggccgatgctgctgcgtttacactgttaaaagagcagttagtagaggttttaagcacattgacagatagagaacagaaagttctgcgcctgcgttttggtctggatgatggaagagcaagaactcttgaagaagttggaaaagagttcagcgtaaccagagagcgtatccgtcagattgaagcaaaagcacttagaaaactgcgccatccaagcagaagccgtaagttaaaagattatctggattaagaacgggtagtaagaaagagagcgtaaagatgcagatttcaaaaagattagaagcagttgcttcttttgtagaacagggcagtgtgattgctgacgtaggctgtgaccatggatatattccgatttatctgtatcagaaaggcatgatacccaaagccattgccatggatgtgaataaaggaccgcttgagcgggccgagattcatattcgtgaatacgggctgggggaatacataacgacccgtctttccgatggcgtccgtgcattaaaaccgaatgaagcagatgccgtagtcattgccggaatgggtggggcattaatggaaaaaatcatagaagagggagaggagacattaaaaagtgtctcctatctcattttgcagccacagtctgaactggcacatttccgccggtttcttcaccaaaaaggatattgtatcgagcaggaaaaaatggtcttggaagatggcaaatattatccaatgatgaaagcgagaaaaggcagagagtcttatgtgcgggagatagattaccgttttggaaagggactcttagaagaaaaaaatcaagtgctctatcagtttttattgaaagaacaaaagtctttggaaacggtgaaagcacgcttagagtcagcaaatacaaagaccgcaaaggcacgccaaaaagaaatcgaaatagatttaaattatgcaaaagaggcattaaaagaatatgaagtgtaaagagataatcgagtcattggaacaaaaatatgcaccggattttgctgaaagctgggataatgtagggcttttagtcggagacaaagagaaagaagtgcataaaatttttcttgcgttagatgtgacagatgaatcattagagatggctataaaagaacaggcagacatgataattacgcatcatccgctgattttttcggcgatgaaaaaagtaacaacagataattttatcggcagaagaatcataaaaatgattcagcatgacataagttattatgcgatgcatacaaattttgatatcctcggaatggcagacttatcagcggattttctgaacttaaaagacagggaaatccttgaagtgacctatagtgatgcaaataggacagaaggtcttggcagagtgggaaatctggcacagaaaatgagtctgaaagagtgtgcagattttgtaaaaacacagttaaaattgccgtctgtgacagtttatggagatttggaaaaagaagtgcagaaagtggcagtttgtaccggttcaggaaagagcctgataaaagaagtgctgaaacatcaggcagatgtctatgtaaccggagatgcggattatcattttgcaattgatgcagtagcgcaggatgtatgtattattgatgccggacattatggtacagagtatatttttatggactatatggaaaaagagcttcaggcacttggaggagaactggaaataaagaaaatgcaggtggttcatccttttaaggtgctgtagttatagttagaaaaagcgttctgataggacttaacaggaggcggacattatggagaaaaagaccgttacagtaaaaattcttggaaagacaagagagtatccgatggggattacttatgcagagattgtaaaagagtatgaaggtgcgacaaaatatccgattgtgcttgtgatgaaagatggaaagttacgggaactgcataagaggctcaaacaggatggaacgctggaatttatcacaacagcagatgagattggtcataagacctataagcgcagtgcaattttactgttattaaaggcactgtataatgtagcagggcatgataagattaaaaaagcagttatccattatgcagtcagttcgggatattatgtgactgtggatggcgatgttgcaattactgaagactttcttttgaaagtaaaagagtatatgctggaactggtagaaaagaaaattccggtaatgaaacgcagtgttggaactgacgaggcgatttccctgtttcataaacataaaatgtatgataaagaaaatctgttccgttaccgcagggtttcaagagtaaatatttacagcattgaggaatttgaagattatttctatggatttatggttcatcataccggttatatcaaatattttgatttatatccttatgatgatggatttgtgcttcagcttccggaaagaaaagaccctgaaatcgtaccggcgtttgaacctcaccagaagattttccaggtgcagaaagaagcaaatatctggggcaaaatgatgcgcacagagaccgttggtgatttaaataatcagattactcatcagggggcaaatgaattgattctgattgcagaagccttgcaggaaggaaagattgcgaaaattgcagaccagattgtagaggcaggtcataaaaaatttattatgatagccgggccatcctcttccggaaaaacaacattttctcatcgtttgtcgattcagttatcggcacatggactaaagcctcatccgattgccgtagataattattttgttaatcgggaacataccccgcttgatgaagagggaaattataattttgaatgtttagaggcaattgatgtcaaacagtttaataatgacatgaatgcgctgcttcgtggagaagaagtagaaattccaacttataattttaaaaccggaaaacgggaatacaagggaaatttcctgaaattagaagagtcggatattctggtcatcgaaggaatccactgcttaaacgataagttaagtgagacccttccaaaagaaaataaatttaaaatctatgtcagtgcgctgacccagttaaatgtagatgaacacaaccggattccgacaaccgacggtcgtttaatccgcagaatagtaagagatgcacgaaccagaggaacttccgcaaaagataccattgccatgtggaactcggtacgaagaggagaagaggcaaatatctttccatatcaggaaagtgccgatgtgatgtttaactctgctttgatttatgaacttgcagtgttaaagatttatgcggaaccgcttttatttggaatttcaccggaagagccagagtatcatgaagcaaaacgtctgctgaaattctttgattattttgtgggaatgccgggtgaggcagttccgacgaactctctgcttcgggaatttattggtggaggatgctttgacgtctaaaaaatacctgaaaaaagagtttacaaaataaaaacagtgtgttaaaatggcgtttgtgtccagtaagatgaataatcgcggctggcaggaccgaaaggggtcaggtgaggaaagtccgggcttcatagggcaggatgccggataacatccggtggaggcgactctaaggacagtgcaacagaaatataccgccggcttatgccggtaagggtggaagggcagtgtaagagactaccgcctttttggtaacagagagggcatatgtaaaccccatccgaagcaagaccgaataaaaagcaatgtggctgcccgtcacgcttttaggttggtcgcttgagtctgttggcaacagcagaactagatagatgattattcacgacataacccggcttacagttttgctggatacaaaaaagaaagcatgagattacagctcgtaaccttatgctttcttttttgtttttatcttaatttttgacttgttttttactgctgtccaagcagatagtcgataaactgctgagcagttcttccggataaaccaccatgctgtaattcccaggcatttgcttttaagagcagttcgttttcatccatttcgatattgtttttctttgcaagggcaaggacgatattttggaattctttcttttccggagaaccaaaatagatagtgacaccaaaacgggaaaccagagaaagtttttcctgtacggtatcattggtatgcagttcttcatcacggtcactcttatctttaaaggtttcacgaatcagatgacggcggtttgaagttgcataaattaaaatgttatttggtttcttttcaagaccgccttcgataacggcttttaaatatttgtattcgatttcaaattcttcaaaggataagtcatccatgtagataataaatttgtaattacggtttttaatctgtgcaatgacatcgtttaagtctttaaactgatgtttataaacttcgatgatacgcagaccctggtcgtaatactgatttaagatagctttgatactggaggatttaccggttccggcatccccaaagagcagacagttatttgcacgttttccgttaataaaagcttctgtattgtcaatcagttttttctttgggatttcatatccaaccaggtcatctaactgaacatgtgcaattctggtgattgggacaatgcgtactgtatcatcactggttctgtgttcaaggcggaaggctttatgaagtccgagttttccgacaccgaaatctttatagaactgaaccatgtcgtccataaattcttctgtagaaacagattcgcttaaacggtcacttaaggtgcagattcggtcacggattcgtttgttaaacattttactgtttccgtcgatgtttttgtaatgacaaagaagcgcagcacagccggtagagaaaacagagtcgagtacttctaaatcaaagtcatagagctgtttaaaaatttcaaaatcatgttttgccagttcattgatggttccatccaccgtaccacgaatttcgcttgcagtactaaaagcattttcatgattgacaagtaaaaatgtaagataatcatgccacagattatcagaaaaaccgtaggcacctgccatttcaacaagctgattcatgcagttgtaataaagcgtgcgtttttcttctaaaagagcggcatcggacagctcttttgattcataagcgtggataatagaaaccatctggtctaagagttctccatgctcaaaattacgatataaaatacattcgtttaaatttatcattttgtgtttccttctttctaaataactaataacgctttgcaaatcttctaagtaataacattgtgctgtgagcgtcaaaagtaaattttgtcacttactgatattagtagttcccatgaacacgtaagttctgaacttcgcttcttaatcctcttaatgcatttttaacggcgctgtcacttaaatttccctcaaaatcaacaaagaagcggtactcccagttgcgtttcagaattggacgggattcaatctttgtcatatttaagccattgtagataaagtgagacaggctgttataaaggcttccgctttcatgaggaagttcatagctgacactgattttatgagcatcttttgcgtaaacttttttctttgcaacaataataaaacgggtagaattatcagagtttgtaaaaatgttttcacttaagatattcagtccaaaatactcggcagcataactgcttgagatggctgcctgtgacaaatcatgttcttcagatacttttttagccgccgcagcggtattgctccattccttctgatgccattctttgtgggcatctaaaaattcacggcactgcatcaatgcctgtggatgggaataaacagtgcggatgtctgaaagagtcgcaccgggaagtgcagttaaaacatgctgacagcggataatctgttctcctacgattacatggtcgtatttagtcagtaaatcgtaattatcctgtacaattccggcagttgaattttcaattgggagaactgcataatctgcgcggccgaatttgatttcttccattgcgtctttccaggtagcaacgtgatagttttttacatcttcaccaaagaaggttttcattgctccatagctgtacgcaccttctactccctggtagacaacggttacattttctttgttaataaaatcaatttttgtaaaatcgcttggttcttcgattccgttttcctgtaaaagctgatactgacgttttcggctgatggacataatctgctggaatagttcttccactccacagcggttaaaatcgcttcctgctttagcaccgagagtctttaatttatcctgttcacggcttttatcgaaaacaggctttcctgtttcaattttaaactgcgccacattttcacaaatcttcattcgtttttcaaaaagacggactatttcgctgtcaatcacgtcaatttcatcacgcatttttcctaaatctaacatggtacttgaatcctctctatttagttttgtagtttcgcttttcgtatgttaaaaaatctgtcttttaaagatgtatcgctttttatcatacaccgacactttaaaccacgcaagttttttatttacggaatagagaaaaaaggaaagggaaacctattataaaatggatagaaacgaaaaaagaagggagaagaagagataagaatggagaaaagacaaccatttattgtgtgtgggataacaggctggtgtctggaactgatttttaccggaattttaagtgcggtacgaaaagatttcagtttaaaaggaacttcttctttatggatgtttccaatttatggaatggctgcctgtatcggaccggtatcgaaaaaaattcggcatgtcccgatttttttgaggggatgtttttatatgactggaattttcggtgtggaactggcaagtggaagtgtgctcaagtatttcaaaatctgtccctgggattacagcagttcacaaattcaatataaaggtttaattcgggcagattatgctcctttatggtttttaaccggcctgctttttgaaaaaatactgtcagataattcttgatattaccaatgttctggtatattataatagagaataaaaatggaaaattagtatagtacacaggaggtaatgtatgagacatttaatgagtcctttggattttgacctggatgaattagacaaggtcttagatttggcaaatgacattgagaaaaatccggcaaagtatgcacatgcgtgtgatggaaagataatggcaaccttattttatgaaccgagtacacgtacaagattaagttttgaatccgcaatgcttcgcctgggtggaaaggtattaggattttccagtgcagattccagttcagcgtcaaaaggagagagtgtagcagatacaattcgtgtggtttcctgttatgctgacatctgtgcgatgcgtcatccaaaagaaggtgccccgcttgttgcatccatggcatcccagattccggttatcaatgccggagatggtggacatcagcatccaacccagacactgacagacctgcttaccattcgttccatgaaaggtcgtttggataacattactattggattatgtggtgacctgaaatttggtcgtacggttcattctttaattgaagcgctggtgcgctatgagggagttaaatttgttttgatttctccagaagaattaaaagtgccggattacattcgtgacgatgtgttaaaggcaagtggtcatgaatttgaagaagtagaacgtctcgaagaagccctccctaaattagatttactgtacatgacccgtgtacagaaagaacgtttcttcaatgaagaagattatgtgcgaatgaaagatttttatgtacttgataagacaaaaatgaaactggcgagtccggacatgcttgttcttcatcctcttccaagagtcaatgaaattgcaactgaagtagataaagacccaagagctgcgtattttaaacaggcgcagtacggtgtgtatgtcagaatggcattgattcttacattattggaggtagaagtatgttaaatgttgggcgcttaaatgaaggtgtggtattagatcatattaaagcaggaaagagcatgatgatttatcatgatttaaaattagataaaatggactgctgtgttgcaattatcaagaatgcaagaagtgaaaaaatgggacgcaaagacattattaaaatcgagtgcccgatcgacagcattgaccttgatattcttggatttattgaccatacgattactgtcaatattgtaaaagacggaagcattgtagagaaaaaagagttaacgcttccaaaagaaattcgaaatgtaattaaatgtaaaaatccacggtgtatcacttctgttgagcaggaattagatcatgtctttattcttgcagaccctgaaaaagaagtttatcgttgtcagtactgcgaagaaaaataccgtcgtaaataggagataagacaagaggtcataaaaagacagtcctgattttttgaaattaggactgccttttttagttatagagtaataaaagagagaacaaagtatggcagagagaaaaacctataaagagattgtacggaaatttttagaaaatgatgaagtagtgatagaaacccgtttggatggagaaagggcgggagaaaagaagatcctgacatcagaagaggcaaagaaagctccaaaagatggatggcatagggagactctgtttgcaaaaccaaaagcggtgcttttaggtggaggacacgtttcgcttgcgattgcacaattattaaagatggtagagtttcgtgtaattgtggtagatgagagagaagaatttgcaaataaggaacgcttttgctgtgcagatgaagtgtactgtatgggatttcaggaattccttgatacaaaagattttggagaacatgcctattatattattgtgacgagaggtcacaaagatgattatacctgcttaagtggtctgcttagaagagaaaagacgtatatcggaatgattggcagcaggaaaaaagttgcaatttcttttgataaattaagagcagaaggatatttagaagaagagattgcacaggtgcatgcaccaatcgggcttgcaatcggggcgcagactccggcagagattgcagtcagtattgcagctgaaattattcaaaagaaaaatgaatcaccagagattatcaatacgcttgaagaagaaattttgaagggcttagaagatgaaaaatcaaaggttttagttacggtaatcgaaaagaaaggttcttctccaagaggagagggaacaaaaatgattgtgcgggaagatgggaaaatttatggtacaatcggaggtggtgcagtggaacatgaggcaattgaagaggcaaaaaattttgatgccgaaaatggatttttaatcaaagactatgacttgtcgaatgcaaaagcagctacccttggaatggtttgcggagggaaggtaaaagttatgtttgaacgtctgtaaaatcaagggtagaaagattggtaagtgaaattaaaaacaggaggaaaagaacatggaacaggatatcaaaaaacaaattgtcggaatacttgaaaaagactgccgtttaagtgaagaagaaattgcagtgatgcttggaaaagagacaaaagaagtggaactggcaataaaagaacttgaaaaagaggggattttatgcgggtatcatgccctggtaaactgggataaagtagatgatgataccgtaactgcgttaatcgaattaaaagtaacaccgcagggcggagacggctttaataaaatcgcagaacagatttatcagtatccgcaggtagaaacgctgtatttaatgtcaggagcatatgatttccttgttatggtaagagggaaaagtatcaaagatatttcgctgttcgtgtctgaaaatctggcttctatcgaagaagtacaaagcacagcgacttactttactttgacaaaatataaagaacagggtgtgaatctgacaagaaaaaaacaggatggaagaatggtgattactttatgagagaatttgtaacagaaaaagtaaagcagattaagccatccggaattcgaaaatttttcgatgtagtcagtgaaatgccggatgcaatttctcttggagtgggcgagccggattttgatactccatggcacattcgtgatgcaggaattaagtcattaaaagcaggaaaaaccttttatacttcaaatgcaggattgatggagcttcgagaagaaatctgccgttataccgaagaaaaaatgcatgtttcttatgacccgaaatcggaagtgtttatcagtgtgggcggaagtgaggcaattgatattgcatttcgggcgacacttgatatcggagatgaagtgattattccggaaccggcttttgtttcttatgtgccgtgtgcccggcttgcaggggctgttccggttgcaattccattaaaagcagagaatgaatttcgtctgacaccggaagaattagaggctgcaattactccaaaatcaaagattttactgttatcttatccgaataatccaacaggagcaattatggaaaaggcagatttagaagccctgtgtccgattattgaaaaatatgacttattggttgtgtcggatgaaatttacagtgagttaagttataaatctgcacacgtaagcattgcgtcacttccgggaatgagagagagaaccatcgtgattaatggattttcaaaagcatttgccatgaccggatggcgtcttggctatgcgcttgcacctgcgcctattatgaagcagatgataaagctgcatcagtttgcgattatgtctgcaccgacgactagtcaatatgcggccatcagtgccttaaaaaatggcaatccggatgtgattgagatgagaatggcttatgaccagagacgacgtttcttaatgcataccttaaaacggcttgaaattccgtgttttgagccttacggtgcattttatatcttcccggatatctcaaaatttggtatgacatcggaagaatttgcaacaaaactcttacaggaagaaaaagtagcggttgttccgggctgtgcattcggagcatgtggagagggatttgtccgtatttcgtatgcgtattcgattgaagaattaaaggcagcatttgaaagaattgagaaattcatcgaaaaaatacgataaaaaaagaaaaaaggctggacattttagtgcgtaaaagctattattaattataattttacagcaataaatagcgttgaggaggatacaaacgaaaatgaagaaagtagtaaaattcggcggaagctctttagcaagcgcagaacagtttaaaaaagtgggtgatatcatccgtgctgacgaaacaagaagatttgttgtaccgtctgcaccgggaaaaagaaattcaaatgatacaaaagtaaccgatttactttataaatgttaccgtgcagcagaaaaaggtcacactgattttgataaagtattaacggaaattaaagcacgttatcaggaaattatcgatggacttggcttaggtctttctttagaagaagattttaatatcatcgaagaaaaatttaaaaatcatgcaggtgaagagtatgcagcatcaagaggagaatacttaaacggaaaaatcatggcagattatttaggctatgaatttgtagactctgcaaaaattatccgttttgacggagaaggtcagtttgatatggaaatgacaaaccgtctgacccgagaatatttaaaggataaagaaaatgcagtaattccgggattctatggagcaatggaagatggaacagtaaaaacattttcaagaggtggttccgatattaccggttctatcgtagcaggtgcactcgatgcagatttatatgaaaactggacagatgtatccggtttccttgtaacagacccgagaattattgagaatccaaaatctattgataccattacctatcgtgaactgcgcgaattgtcttacatgggtgcgactgtactgcatgaagatgcaatctttcctgtaagaaaagcagggattccgattaatatccgaaatacaaacagaccggaagatgcaggtactatgattgtagaagatacctgtaaaaaaccggcttataccatcacaggtattgccggtaagaaaggattctgttctttatttatcgaaaaatccatgatgaactctgaaattggatttggcagaaaagtacttcaggttctggagaaagaaggaatttcttttgaacatctgccatccggtattgatacaatgaccctgtttattcatcaggatgagtttgcagaaaaagaacagcaggtaatttccggaattcatcgtgcagtcaatccggactttatggaattagaatctgacctggcattaatcgcagttgtaggacgcggtatgcgttcaaacagaggaacagcagcaagaatctttgcggcactggctcatgccaatgtaaacgtaaaaatgattgatcagggttccagtgagttaaatgtcatcatcggtgtaagaaatgaagattttgaggtcgctgtaaaagcaatttacgatatttttgtaacaactcagctgtaatcataataatcataatgagaaggaaaaagtacattcgattttttggatgtactttttttgttgacaaaatctaaaatatcacgtatactacaagtgtactaagacagatagtacactaaatacacacggacagcatagaaaggaagtgaaacttcaaatggtcgtaattgattatcaaaatcgaaaaccgatttatgaacagattgtagaacgatttcagatgctgattgtaaaaggaattttagagccggactcgcagatgccatcggtacgtgcgcttgcgacagaactttcgattaatccaaatacgatacagaaagcttatgccgtactggaacaggaggggtatatctatccgataaaaggaaggggaaattttgtttcgggaaatcaggcattagtcaaacaaaaaaaagaagattttcttttaaaactgcatggggtattaaaagaaggaaaggaaatcggagtgaccggtgcacaatgtctggaatgtgtgaattccgtatttaaggagggagaacatgattaatacaacacagctttcaaaacagtttggagatttaaaagccgtagataaaattagtctccaaattgtggataacagtattttcggacttgcgggaacaaacggagctggaaaaagtaccttccttcgtatgcttgcaggggtgttaaagcaggatgaaggagagattgaaatcgatggagaagcagtctgggaaaatgaaaagataaaaggtgaaattttctttttgccggataatgcttattttccgccaaatgtgacaccacagcagatggcaggttactatagtatttattacagtaaatttaataaaaaacggtttcaggagttatgcgataaattagagttagataccaaacgaaaaatcaatacattttcaaaaggaatgaagcgtcaggtgtcgatgctgcttggaatctgtgcaggaacaaaatacttgttttgtgatgaaacatttgatgggttagaccccgtgatgcgtcaggcagcaaaaagtattcttgcatacgaggtgacggaacgtccttttacaccaattattgcatctcataatttaagggaattagaagatatctgcgaccatgtaggattattacataaaggcggagttttgctttcaagagaactggaggatatgaaaatgcatatccataaagtgcagtgcgtgattcaaaatccgcttttggaagaagagttgcttcgggaacttgatgttgtacagtctgaaaagcgtttatctttattgaccttaattgtaagaggtgaaaaagacaagataatggaaacggtagaaagtaaatttccgctgtttgcagagatgataccgcttacactggaagaaatctttatcagcgaaacggaggtggcaggatatgacatcaaaaaactgtttttctaaaatgctagtacgagatttaaaagagagaggcgtctggctgattagttccattattttatttctcctgatttatccggttcagattttaatgagtctggatgcaattgcttcttatatgaaaggggaagaagaatttcaaagcagaattacagaacagttttcaagtctgattagttttggaaatgggatcatgtatgttgcaatcgtaatcatggcgtttttactggcaatgtcaggattctggtacgtatattcgggagtaaaaacagatttttatcacagtcttccgataaaaagagaaaaattgtttttagaacgctatgttactggaattttgatttttatagttccgtatttcattagtctgatacttggatatggtgccggaatcatgaaaggagcagagacttctggaattttaagtttatgtgcaaaagggtttgtcacaaatgttgtgttgtttttgcttttttataatcttgcagttttaggcgttctgcttaccggaaatttatttaccggagttttggcgtatggggcatttttaagttacggagttttgttagagagtacaattggtctaacaaaagtagctttttttacaacttatatagataactcaagattgagtcaggtttttgaagggaaatttggaaagttaagtccactttatgtgtttgatatgattctgtcaaataataagatttcgatgaaggatgtcagtgtagtctttggaatctcagtgctgtttttggtaatctgcatgtttgtttataaaattcgtccgacagaagcttatcataaatcaattgcttttaagaagttacagccaattataaaggttgcagttgtcattccgttttcagcatgtgtaggcattttatcaagtgaaattgtcggacgaaattttatctggtatgtgggaggtttgcttgttactgctgtgctcttatcctttgcaatggaatttttatattatttagatatcagagaatgtattcgtccaaaaatttctaccggattaattctgggaatgctggtgataatggcggtgacattaaagttggatttaataggatttgatacctatttaccaaaagaatcaagagtaaaaaacatgtccatttatattgatggattaaacagctgttatgattatccggaaggcgccggagagatgtacggaacagttccttttttacagaataccaagatagaagagtttgatgccatttatcagcttgcgaaaaaagcagttgcaattcaaaaagcagataaggtaactgcagattctgaaataacagattccgaaataacagattccgaagaactttatttttctgtttgctatgaaatgaaaaatggaaaagaggtttaccgcggatactgcattccgaaggatgaagaaaatctgaaattaattgcagatatttatgataattgggagtttaaacgacaggttcttccggtagaatatgtaaaagaagaaaagatttcttctcttgaaattgcggatctccagtcatctcatgattccgaactctctaaagagacaataaaaagtctgtttaaaacctgtaaaaatgaatgggagtctgcaacatatgagcagttgagtaatgataaagtacttggatttttacgattttatctggattatgacagagaaaacggtgattatgataccggatccagatgtgtaagtgttccggtttactcaagttttcagcagacgagaaaactcttagaacaaaacggctgtaaaatgatgacatttgaagattatgataaggtagaaagaattgagataagtcaatatgacgataaaacaggagaccttggaggtatcctaaatgtcaccgatgaaaatcagattcgggaaatacttgaggctctttacataacagataacagtgaaatatttgatataagcacgataaactatcagattgaagttcagattgactggaaatcggaggtctttaataatacggatggtttttgcagctgttatttccgcaccgatgaagtaccggaatttgtaacaaaagaattagaagaataaataataacacctgtgccaattaatgcgctttggcatgggtgtttttcgttcattgacaatcggataaaaagcagagtaaaataagtgcatcagaataaacgagaaacaaggaggaaattatgagacgaaagttatcctttgatgatgaaaaggatttggttttgcttggcaaagcactttcttctgaaatcagaataaaaattttaaaactgcttgacaccaaaccttactgtgtcaatgaaatcgcagagcttttaaagattccggcatcttcagcagccttaaatgtaaaagtattagaggaggcacaactgatacggacggagttaaaacccggagtcagaggttctatgaagttatgcttaagacaaaatgatgaactgcttttgcttctaagaaaaggagaaaagaaaaagaaagaggaagtcatttccatgccggttggaaattatgtggattataaagttgcacccacctgtggaattgtcaatacagaggactatattgacggggaggatgaaccaagatgtttttataatccactgcgtacgacagcaaagctggtctggtttgcaaaggggtatctggaatatcgttttccaaatgccggaatccagaatgggagggtcagacgactggaattatctgcggaactttgttcagaagcaccggattataacatggaatggccatccgatattaccctttggattaatcagagggaagcaggaacgtggacgtgtccaagtgattttggaggacgcagaggaaaattaaatccagactggtgggaagacaagaatacccagtatggaaagttaaaagtctggacattggaggagaacggaacatatctcgacggaaaaaaagtaaatgatgtttcagtaacagattattgtctggcagatggtccgtttatctctgtgcggattggagtaaaagaggatgcaaagcatcagggcggtgtgaatttgtttggaaattcatttggagattatccacaggacattgtgatgcggattctatatgagtaaataaaacttgaaaaaatcaagttttgtggtataataaaaacaataataatgttttaaaacataaattatattttgcaaaatttgggaaggggaacgacatgttaaacgaaagtatcaaaaaactggttacttatggaatggaaaccggactcgtaccggaatgtgaaagaaactacacgattaatctgttgctggatttatttcatcaggatgattatgaagagccgcaggaagaatatacaaatgtagatttggaatcaaccttaaaagaactgcttgatgaagcggttacaagaggcattattgaggacagcatcggttaccgcgatttatttgataccaagattatgaactgtctgatgccacgtccggcacaggtacagcagaaattcaaagaagagtatgcaaaatcaccggaatgtgcgactgcttatttttataaattaagtcaggacagtgattacattcgtcgttaccgtattaaaaaagatagaaaatggacggcagaaagtccttatggcacaattgatattaccattaacctttcgaaaccggaaaaagacccgaaagcaattgcggcagctaaaaatgcaaaacagagcagttatccaaaatgtcagctttgtatggaaaacgaaggttatgcaggtcgtttaaatcatccggcgagagaaaatcacagaattattccgattacaattaatgacagcaagtggggattccagtattctccttatgtttactataatgaacactgtatcgtatttaatggacagcatgtgccgatgaagattgagagggctgcatttgtaaaattatttgattttgtaaaacagttcccacattatttccttggttctaatgcagatttaccaatcgtaggtggttcaattttaagccatgaccattttcagggtggtcattacacctttgcaatggcaaaagcgccgatcgaagagcacgttaccattccgggatatgaagatgtggaagccggaatcgtaaaatggccgctttctgttttgagaattcgtcacaaggatgagaaacgcctgattgatttggcgacccatgtattagaagtgtggagaggatatacagatgagtcagcttttatctttgcagaaacagagggagaaccgcataatacgattactccgattgcaagaaaaaaaggcgatgtatatgagcttgatttaactttaagaaataatatcacgaccaaagagcatccgcttggtgtctatcatccacatgctcagtatcatcacattaaaaaagaaaatatcggtctgattgaggttatgggacttgcagtacttccggcaagattgaaagacgaattagagctgcttgctgagtatctggttgagaaaaaagacccggctgaaaatgaaagcctgaaaaaacatgcagactgggtaaaggaatttttaccgaaatacgaagaaattaccaaagaaaatgtaatgggaatcctggaagaagaagtcggacaggtatttgtaaaagtcttagaggacgcaggtgtttataaatgtacgaaagagggaagagacgcctttaaacgttttatttccgtattataaaagcagaatagaataagtgaaaaagggaattgtcatattaaaaatggcagttccttttttatatccgttcttaccttgtttgttctcttttaagtgtgctataatgagtgaaaagaaaaagaaagaggtcgataaaatacagatgaaaaaaagagtagaagattcacagaccgagcagacgtatctgatgcgtcccatttatttaaatgaatatggaaatctttttggtggtcagctgatggaatggatcgatgagatcgccagtattgtagcaatgcgccacagtgaggcagacattacgaccgcctgcattgataatttgaattttaaagagggtgcaaccgtaaatgatgtcattgtgcttcgcggaaagattacttatgtaggaagaacttccatggaagtgcgggttgatacttatgtggaaagccgtcatgaaatccgcaaggttatcaaccgtgcttacgtggttatggtcgcggtggatgagcatcaccatccgattccggttccgggtctgattgtagaatcagaatcggaaaaagcagagtgggaaggcggcgaaaaacgctacgcactcagaaaagaaagaagaagagagggctattagatgagcgaaaaaatcctgctgatagacgggcacagtattttaaatcgggcgttttacggacttccggagcttacaaatgcagaaggacttcatacaaatgctatttatggctttttaaatattttatttcggattgtagaagaagaaaaaccggattatttaacggtggcatttgatttgcatgcaccgacctttcgccataagatgtatgcagattataagggaaccagaaagggcatgcctcaggagctaagagagcaggttccggttatgaaagatgtcttaatggcgatggggattacgattgtcgcaaaggaaggctacgaggcagatgacctgcttggaacattggcaaaaaagagcgaagcaaggggaatggatgtaacggtgctttccggagaccgtgacttgcttcagcttgcaagtaagcatatctgtatccgaattccaaagaccagatttggaaaaactacgattgaggattattttgaagaaaatgtcaaagaaaaatatcagctgacaccggcacagattattgaattaaaggcgctgatgggtgattcttccgataatattccggggcttccgggtgtgggagaaaagactgcgacaaagattttgctggaatacggcacggtggaaaatgcatggaaacatgtcgaagaattaaagccgaataaagcgaaaaatgcgttcttagaacattatgatatggcaattttaagtaaaaaacttgcgactatcaatattgacagtccgattgaatatgactgggaaagtgcgagaatcggagaattttacacaaaagaagcttatgaatattttaaagaactggaatttaaaaatttcttatcccgttttgaagaaggggcagaaccggcaaaaattgcagtttcttttcaaaacgtaaccgattttacagaggcagatgcgctgtttgaaaaactggtgaaagaaccggaacttggaattgaagttttaagagaagcacatcagtttttggggcttggacttgcatggaataataaagaaaaagaagaagtggaaacagtctgcatttttccacagggatttttaacagaaagttatctgatggaccaggtgcagaagctttgtgaaaaagtagaaaggatagatgctcttgatgtaaaagagacaatttcagaaatttcaaaagtttcgcataagaaggtgtttgatgccggaattgctgcatatctgttaaatccactgaaatcttcttacacctatgatgatattgcaaaagagtacttaggagaaatgcttccggcaaaagaagacttgattggaaaactttcctatacaaaggcaatgagtgaaaaagaagcaaaagagaaagaagtcgcaaaaagtatctgttatatggcatatacagcattaagaagccggaaggcgctgatggaagcacttgaaaacaataatatgaaagcgctttttgaggacgtagaactgccgctgttatttacactttctaatatggaaaaagagggaatccgcgtcaatgcagaagccttaaatgaatatggaagtcagcttgaggtaaaaatcaaagcattagaaagccagatttatgaagaggcaggagaagagtttaacatcaattctccaaaacagcttggtgtaattttatttgaaaaattacagcttccgggtgggaaaaagacgaagaccggatactcaaccgcagcagatgttctggagaaacttgcaccggaacataaactggtagcagatatcctggaatatcgtcagcttgcaaaattaaaatccacttatgcagacggacttgccggatttatcggggaagacggcagaattcattctacgtttaatcagacgattacggcaaccggaagaatcagcagtacagagccgaatcttcagaatattccgatccgtatggaactgggacgcctgattcgtaaagtctttattccagaagatggatttgtatttgtggatgcggattattcccagattgaacttcgtgtgcttgcgcatttatcaggggatgaaaatctgattgaagcctataaagaagcgcaggatattcaccgaatgacggcttctcaggtctttcatgttccgtttgaagaggtgacggatttacagagaagaaatgcaaaagcggtgaactttggaattgtatatggaattagttcgtttggattgtcacaggatttaagtattacaagaaaagaagcagcggaatatattgaaaattattttgctacttatccaaagattaaaggcttcttagatggactcgtaacagaggcaaaagaacagggatatgtggaaacaatgtttcaaagacgtcgtccggtgccggaaatccgttccggaaactttatgcagagatcctttggggaacgtgtagcgatgaattctccgattcagggaacggcagcggatatcatcaagattgcaatgattcgtgtggaacaggcattaaaagagcagaatctggagtcacgtctgattttacaggtacacgatgaactgttgatcgaagccaaagaagacgaggtcgaggcagtaaaggcaattttagagcgggaaatgaaaggtgcggcaaacctggcggttccgcttgaaattgatatgcataccggaacaaactggtatgaggcaaaataaaaacctggaaaaaatacaagatgaatcataacgtacgaaaggggaaagtggtatgagagtaataggggtaaccggtggagttggttccggaaaaagtgcggttttaaattatattgaagcacattttgatgcaagaattataaaggcagatgatgtcgggcatctgttgatgatgccggggcaagtctgctatgaaccggtcattcaactgtttggtgagtggattgtcaaagaggatggttcattagatcgtgaaacgatttcaaagattgtatttgagaaaaaagaaattcttgaaaagttaaatgcaatcattcatccggcggtaaaaaaatatattttaagagagattgaacgttccaaaaaagaaaaaaccgaatttttctttatcgaagcagctcttttaattgaagaaaaatatgatgaaatctgtgatgaattgtggtatatttattgcgaaaaagaagtccgcatggaacgtctgcgccataatcgtgggtattccgataaaaagattgagcagatgttaaagaaccagctctcggatgaggagtttgagtccaaatgcgacttccagctttataatagtgaagatgtggcacatacctatcttcagattgaaaggaaaatgaggacttattatgaatctatgtagcattgccagtggaagcagtggaaactgcatctatgtaggcagtgataaaaccagtgttcttgtagacgcaggaatcagcggaaaacgaattgagcagggattaaacagtattgagcgtaccacaaaagactgcgatgcaattttaatcactcatgaacattctgaccatgtcaaaggacttggagtgcttgcaagaaaataccacattccaatttattgcaccaaaggtacaatggaagaattaaaacaaatgtcaatgcttggaaagatgccggagggactctatcgtccgattctggcagaagaaacattttcaattggagatttatccattctgccatttgaaatttcacatgatgcggcagaaccggtaggctatcgggtttctcatggagaaaaatcggtagggattgcaacggatatgggagtctatgacgaaaaaatcgttgaaaaccttcagggactcgatgctctgcttttagaggcaaaccatgatgtgaggatgcttcaggtcggcgcttatccgtattctttaaagcagagaattttaggggaaaaaggacatttatccaatgaatcggcgggaaggctgctctgccgtctgcttcatgataaaatgaaacagattatgcttggacatttaagccgggaaaataattatgagatacttgcttatgagacggtgtgtgcagaagtgacgatgggagaaaacccatggaaatcttcggatttcaaaatatctgttgcgcacagagaccgtgcatctgaactgataaccgtatagaaaaattttagatagaaaacaggttgtaaaatgcggcaaaatgcagtaagataaaacataaaaaatacgcttggaatttttgagagtgaaaaaggagaacatttaaaatgaaaaaaacgattatcaccgtagtaggacaggacacagtgggaattattgcaaaggtatgtacttatcttgcagaaaataaaattaacattcttgatatttcacagacaatcatcgatggctattttaacatgatgatgattacagatacttcaaagtctgagaagaaactggataagatttctacagatctgacagaattaggcgaacaaatcggtgttgcaatccatgcacagcatgaagacatttttaacaaaatgcatcgtatctagttaaattaagcagttgctggattgacgctgaatatttgcggaactggtagttctgagtttagttctaatttctgaaaggataaaatacacatgattaacatatttgaagtaaatgaaacgaataaaatgattgagcaggaaaacctggatgtgcgtaccattacaatgggaatcagcctcttagactgtatcgattctgatttacagcaggtaaaccgcaaggtttatgaaaaaattacaacactggcaaaaaatctggtagaaaccggagaagagatttcaaaggaatatggaattcctgttgtaaataaacgaatttccgtgaccccgattgcactgattggcggtgcggcatgtaaagcaccggaagactttgtgacactggctcagacattggataaagccgcaaaaaaagttggggtaaactttatcggtggttattctgcaaccgtttcaaaaggaatgacaaaagcagatgaaatgctgattcgttctattccggaagcattggctacaacagagagagtctgcagttctgttaatcttggctctacaaaaacaggtatcaatatggatgctgtaaaattaatgggtgaaattgtgcttgccactgcaaatgcaacaaaagaacaggattctcttggctgcgcaaagctggttgtattttgtaatgcaccggatgataatccatttatggcaggtgcgttccatggagtaacagaagccgatgcaattatcaatgtcggagtttccggtccgggagttgtaaaaactgctcttgaaaaagtacgtggaaaagattttgaagtattatgcgaaaccattaagaaaacagcatttaaagtaacacgtgttggacagctggttgcaaaagaagcttccaaacgtcttggtattccgtttggtatcgtagacttatcgcttgctccgacaccggctattggtgatagcgtagcaggaatcttagaagaaatcggtctggaatatgcaggtgcacctggaacaacagcagcacttgcactcttaaatgatcaggtcaaaaaaggcggagttatggcatcttcttacgttggtggcttaagtggtgcatttattccggtcagtgaagaccagggaatgattgatgcggtaaaagcaaatgcactgaccattgaaaaattagaggcaatgacctgtgtctgctctgtaggtcttgacatgattgcaattcctggagatacaaaggcaactaccatttccggtatcattgcagatgaatgtgcaatcggtatggtaaaccagaaaacaacagccgttcgtgtgattccggtcatcggaaaagacgtaggcgaaacagtagaatttggcggtctgttgggatatgcaccgattatgccggtgaatccatattcttgtgatgcatttgtaaatcgtggcggaagaattccagctccaattcacagctttaaaaactaaaaaagccaaaattgcagatgacagacaaagcaggaagaaaaaaatgtaccatagattttggcttgacaaaagagttagattatgctaactttggagtagaaacagaaacaaagacagctgaaaaagaaagaagatgttgatatgaatataggtacatttgttgttttagttattgtagcatgcattgttggtctggcagcacgaaaggtctggaaagataaaaaatccggaaagagctgcagtagttgcggaggcagttgtggtggatgcagcggatgccatccggcaccatcaaagaaaaaataaaaaacaataaagatagaaatacgatgaatcattataaataatggttcatcgtatttttttgtttcatcaaaattggggatatggtagaataaagcataaacttaagtgaggcagaagaaaaccctaaggtaaaaaagaaaggaagcgaagcatgacggattatgtaagtttacaagatgtaacaaaaacctaccgcatgggtgagattacaataaaggcagcagatggaatcagttttgatgtacaaaaaggcgagtttgtcattgtagtcggaccaagtggtgcgggaaagacaaccgttttaaatattcttggaggcatggatgttgcaacttccggaaaagtatttgtagacggagcggagattacaaaatatcgggggaaaaaactgattcagtatcgaagagaagagattggatttgtctttcagttttataatttaatgcagaatctgacagcacttgaaaatgtggaacttgcaatgcagatttgtaaatatccgcttgatgccaaaaaagtattagaagaagtaggcttaaaagaacgaatgaacaattttcccgcacagctttccggaggagagcaacaaagggtggcgattgcacgtgcacttgcgaaaaatccaaaattactgctgtgtgatgagccgacaggcgctcttgattatgtaacaggaaaggcaattttgaaattattgcaggatacctgtcgggaaaaagaaatgacggtaattgtcattacccataactcggctcttgcaccgatggcagaccgtgtgattaagattcggaatggaaaagtggcagaaaccgtattaaatgagaaaccgatgccggtagaagagattgaatggtaggaagaaaggaaaaagatgaaagcattttggaaggatttctttcgggaaatcagtaaaaataaaggtcgttttctatccgtatttttcatcgttttgttaggttcagcatttttttccggaatccgctcggcagaaggtgatatgaaagtatcagcagatcgatattatgacgatgtcgattatatggatttgaaaatacttggaacaatgggtctgacggatgaggatttaaaggatatccaaaatacagagagagtaaaaaatgtaaccggaggacataccttagaagtcttacataaagtaggagaaaaagaacaggttgtcaaattaattgcgctgacggacaaagtaaatgagccacaaatcaaagaaggaaggatgccggaaaattcagacgaaattttagtggacgagagttttttgagttattcagactgtaaaatcggagataaagtgacatttgaatccggaacagacgaggcagttacggattctctgacaggagatacctttacaattgtcggaactgcgacactgccgtattatatggatttaaacaggggaacaggttcaattggaacaggaagtattaacagttttgcactcttagagccggaagtatttacttcagatgtttacacagaactttatgtacagatagatggagcgaaagagtcagccagctatagtgacgaatatgataaaacagttaagaaagtacaaaagaaaatagaagcgttagaagactcagcctgtgacagacgatatcagaccatccagaaagaaggacaacaggaaattgcggatgccaaagagcagattcaggacgcagaagagaaacttgcggatgcaaaacaaaaactggatgatggagaagttcagctttccgatgcaagaaccacgatttccaaaaaagagcaggaactaaacgatggagagagcgagttaaaagcaaaagaagcagaactggaatccggcaagcagaccttagttcaaaaaacaaaagaattagaaagtgcaaagacacagataacggaaaagaccaaagagttagaaagtggaaaacaggctttagaatccgggaaaaaagaacttgaagcaaataaaatacagcttgcacaaaaagagcaggaattaaatgccggaaagacacagcttgaagaagcaaaaatacagcttcagacaaagataaaggagtttgaaacaggaaagagccagtatgaggagaaaaaatctgcttatgaagcgcaaaaaagtcagatagaaacagcaaaaacacagctggaagctgtgagtgcaggaattactcagatagaaaatgcgcttactgaaatgaagaatcagctggaaattttggaagagcagttagccaaaagcgagagttcagatgaaacttatgagacacttttggcacagaagaccgaactggaatcccagataacagcccaaagcgaagcactttcaacacttattgctcaaaaagaagcgttagaagcaggaatttcggcatttgaatcagcaaaaccagaggcagaagcccggctggaaaaggcaagaatacaaatcgaagaagcaggcacgcagattgaacaggcaaaggcaacgctgtcccaaaaagaagaggaattaaatgcagggcaggttcagatagattctgcgaaaaagcagttacaggaagcagaagaaaagataaaacagaatgaagccataatttcggatggagaggcacagcttgtacaggcacagaatcagataaaagagggagaaagccagattttggaagcacagaatacgcttgctgatggagaaaaacagcttaccgatgccaagcagacgcttgccaaaggacggacttcccttgaagaagcaaagagtgaattagaagcaaaggcacaggaattagaggacggaaaagcagagtatgaaaccgcaaaaaaagatgctgaaccggaaatcgccgatgcaaaacaaaaaatttcagatggagaagaagaactggcgaaattggaagttccaacctggtatgtctggggacgagataagattacttcaacagaaagttttggacaggatgctgagagaatttcaaatatcggagaatttttcccggttatcttctttttagttgcggcactggtcagcttgacaaccatgactcgtatgattgaagaacagcgccagcagataggaacattaaaggcacttggttattcagatggaaaaattgcattaaaatactttgcttatgcaatggtttctaccgtctcgggtgcacttgcaggcgtggtagtcggagaaaaaatcctgccctgggtcattatgaatgcgtatggaatgttgtatacgggacttctttattacctgacaccattaaactggcatcagggaggacttgctgttttggcaagtgcaggctgtaccggagttgcggcccttgccgcatgccagaaagagctgatgtcaaagccagctgaactgatgcgtccgcaagctccaaaaaatggaaaacgtatctttttagaacggattgatatcttatggaaacacttgaactttacacagaaatctacagtacgaaacttagtgcgctataaaaaacgattttttatgaccgtaatcggaatcggaggctgtatggggctgatattggttggattcgggcttcaggattccattactgccattgccaagaatcagtttgttaatttatttacttatgaagcaaatgtaattttagattccaacgtttcggaggctgaaaaagaagcccagcagaaagacttaaaagcttatcagggaatcgatgagatgctggaactctattgtcagaatgtagagctgcaaagtgagaaaaagacggtagatactgtgcttgaggtaccaaaaacgttagatggatttgaagatttttttgaatttcgtgaccgtgtaagcggtaaacattatgcctttccaaaagaaggagcagctataagcgaaaaaacagcagatatgcttggggtaaaagtgggagatacggtagaactaaaaaaaggagatacgatagttaaggtcaagatttccgttattgtggaaaattacgtccgccattatctgtatctgacaacagagacttataaaagtctgtttcatgagactccggattataatcagctgttgttaagatatcaggatacttcaaaagattatgaggatgcactcggagaaaaaattatgaaatacgacagtgtggcagcaatttcttttacctcggatttaatcggccagattgatgacatgctgcgctcccttgatattgtaattgtggtgctgattgtgtcagcagggttgcttgcctttgtggtattgtataatttaaacaatattaatatcacagaacggcagagagagctggcaacattgaaagtattgggattttatgatggagaagtggcatcctatgtgtatcgggaaaacattgtgctgactctgtttggaattatcgccggaatgggaatcggaaactttttgcaccattatgtgattcagacagtggaagtggatatgatgatgtttggacgaaatgtatttttcagaagttatttttacagcggactcattaccctggcatttgcattgtttgtaaatggaatgatgttttaccgactgcgaaaaattgacatgattgaatcccttaagagtgtggagtagaaaggaaatcaatatggctttagtgacaggaattattgcagaatacaatccttttcataatgggcatgcttatcagattcaaaaagcgcgggagctaaccggctgtgattttgtggtggttgtgatgagcggagattttgtacagcgtggcgcaccggcacttttcgataagtataccagaacaaagatggcacttttggggggcgcagacctggtactggaattaccggtctgggcttccagcgccagcgctgaattttttgcggcaggagcagtttctgttttagagggaatcggctgtacggattttttgtgttttggagcggaagatgagaagctctcaaagatgcagaaagcagtgaagctgcttgcagatgaaaatacagaatttcagaaacaacttcgggatgcgctaaaaacaggtctttcttttccggctgcaagaaaacaggcgctaagcggtttcttaacagaagaagagagcagtatcttagataagcctaataatattcttggaattgaatatttaaaggcattaaaagcaaagaactcttcgatagagccggtgattgtaaaaagggaagggcaggggtatcatggacaggaactttcccatggatttgcaagtgcttcggggattcgcagtgccttaaaagacgtgggagactgggaacagcatgagaaaatttctcagcttttccatgtaatgccaaaggaaattacagaaatttttatagaggcaggaaaacagaatcagatggtatgggaggatgatttttctctgctgttacaatacaatctgcttaagcagaaaaacagattacagctgactgcttacagcgatgtttcaaaagaccttgcaatgcggatttctaaaaatttaaatcaatttgagtcttatagtagttttgttcagaaattaaagacgaaagaactgacgtatacccgaatttcgagggctttgcttcacattttattagagataactcaggaagagactcgaatgtttctacacaatccttatactcgaattttaggattcaggcaggacagcaaagaagtgttaggaaaaatgaaaaaagcaaaagaaattccggtacttacgaagatttcgaattatcaaaaagagttggcaaacattcaaaaaggtctgtttgaaaaagatatctttgcgtctgatctttatgaggcagtgaccggaagaaaacaaaaaagaggattgacaaatgaacttcaacattcgccgattattctaagataaacaaggaatgtttggaaaagaatacaatttttgtgcataattttcaaatgcacacttgtaccgtttttggaaacgatgtataataaaaacaggcacgaccatctctaggtcgtaatgaattagcataacggaggaaaaattatgaacgtattagtagtaaattgcggaagttcatcattgaaattccagctcatcaactctgaaacagaggaagtagcagcaaaagggctgtgtgaacgtatcggtatcgatggaagactggtatatcagccaacaaacggagaaaaagaagtaacagaagcaccaatgccaactcatacagaagcaatcaaaatggtattagacgctctggttaatgaaaaaacaggtgtattaaagagccttgacgaagtagaagcaatcggacatcgtgtactgcatggtggagctaaaatctctgattcctgtattatcaacgatgaagtaatctctgttatcgaagagtgctgtgaccttggtcctctgcataaccctgcaaacctgatgggtatccgtgcatgtatggaactgatgccaggtaaaccaaacgtagctgtatttgatactgcattccatcagacaatgccggaaaaagcatatatgtatgcaattccgaaaaaatactatgatgaatataaagtacgtaaatatggtttccacggaacttctcatcgtttcgtatcgaaagaaacgatcaaattccttggtcttgacccggaaaattctaaagtaatcgttgctcatcttggaaacggttcttctatcagtgcagttgtaaatggaaaatgtgttgacaccagcatgggtctgacacctcttcagggtcttgtaatgggaacacgttccggtgaccttgacccggctgttcttgaattcatctgtgcaaaagaaaacattgatgtaaaagaaatggttcgtatcttaaataaagagtccggtttattaggactttctaacggactttccagtgacttccgtgacttaaacgaagctgctgaaggcggaaacgaagatgcaaaacgtgcagtagactgcttatgctacagcattatcaaatacatcggttcttatgtagctgctatgaacggtgtagatgcaatcgcatttacaggtggtatcggtgaaaatgcaattccggttcgtgaaactgttgtaaagagtctgggatatcttggaatcaaattagatgaagaagcaaaccagacaagaggagaaaataaagtaatctccacagcagattctaaagtaaaagttgcaatcgttccgacaaacgaagaacttgcaatctgtcaggaaacagcagaactggtaaagaatcagaaataatagttgacaaaaacgaattacctatgtataattgacaaggtgtgattaggagactattatgctaattgatttatcagatattttatccgtggatggaaagacgaaagaattaaaaatgccggtttccatggattcctttgaatcaaaacttggcagttttccggtagtagaaaaacagccgttagatgttgtaattacgaatacaggaaaaaaagtgcttcgaattgaagtaaaaggcaaagtgagtcttgctctgccctgcgaccgttgtcttaaagatgtggcaacggaatttgaaattgaccttgaaaaagaggttgatatgaaaacttcagaggaagacaggataaaagacttagatgaaattaattatatcacaggttgtagcctggatattgagcagttagtgcataatgagattttaatccattggcctatgagggtcctgtgtaaagaggactgcaagggaatctgcagccattgcggaaaagacttgaatgaagggccatgctcatgtgagcaggagagcccggatccacgaatggcggcaatccgtgatatatttagcaaatttaaggaggtgtaattatgtccatctgtccaaaaaataaaacttctaaagcaagaagagataaaagaagagcaaactggaaaatgactgctccgaacttagtaaaatgcagcaaatgtggtgctttaatgatgccgcacagagtgtgcaaagcttgcggaagctacaacaaaaaagaagttattgctatggatgctgaataattcatagtatgaggggctgtcgtgtttaggcacggcagccttttttcattttataaatttataaatgaattttgtaataaatttgtaataaaattgcaagtttttcttgcgattttccagaaaacaagttaatataagagagaacttgttaaaggaggagtttagtatgaataatagatggtataaaaaattattactgcttcttacggtaggatgcatgactgtttctatgaccggatgcagtgcagattctgtattagataaattattgtcagtgactgacccaaagccggataaaaagacagaggcaacgaaagaggatagcagtgataaaaaagacagtgcaggtgaaaaagaagtagaagtggcaaaaccggaatttaccacaaacttaagtggagcggtgacttatgcggtaaatgccaaagcttctgcactgacagtagaagcaactacgacggatgatggaagtattacttatcagtggtataagagccagaccgatacgaatggcggtggaactttaattgacggggcgacagaagcaagttacactccgccaaccgataccgaagggacactttattattatgttgtagcaaccagtaccattggttcttctacaaatggagcaaccagtgataccgcagaagttattgtgtcagcggatggaaccattccgtctgaaagcgaagaccaggcaggtgcaagtaaggtacttggcaaatgggtacagaataatgatggctggtggtatgataatggggatggaacttatccgagaaatgcatggaaacagattgatggaaaatggtatgcatttgatgaaaaaggttatatgagagtcggatggtttaaagatggagactcctggtattatctgttagacagcggagagatggcgaaagatacggatattgagggatatcatattggttcaaatggcaaaatggaataaaggaataaacaacagttcatcgcaggcacgctctcgctgcttgtcgctggcagtggtacgtaagcgacgaaaataccgtcgctaagtaccagccgctccaaagcacctgcttatgaatctgttgaaagcaaagagtggcagggatgaacgagatgcaaatggcagttggcatcatttgttccgatgtgctgtagtataaatctgttgaaaacaaagagtggcagggatgaacgagatgcaaatggcagttggcatcatttgttccgatgtgctgtagtatagatctgttgaaaacaggaagtggcagggatgaagtgattttgggcggtcgtaaaagagattatcttttacggccgtttctcttgccctttttttagatgtctggtaaaattaggggcatagcgtacaggaggcgatgaaatggagaaaatggagaatctgattacagtggtagtcgacgccatgggcggggataatgctccgcatgagattatcaaaggggcagtcgaggccgtaaaagaaaaacaaaacttaaaggtacttcttgtcggacaaaaagaagtggtggaaaaggaattaagcgcttatgattatccgaaggagagaatagaagttatacatgcatcagaagtgattgagactggagaaccgccggttgctgcaatcaagggaaagaaagattcttcgattgtagtcggaatgaaactggtcagaaagggagaggcagatgctttcgtttctgccggaagttccggtgcgattttggttggcggaactacaattgtaggtcgaatcaaaggaattgagcgtgcaccgcttgcaccgatgattccaacgaaaaatggcgcatcacttttgattgactgcggagcaaatgtggatgcaaggtcgtctcatcttgtgcagtttgcacgtatgggttctatttacatggaacatgttgtaggggttaaaaatccaagagtcggaattgtgaatattggtgtggaagaggaaaaaggcaatgccctggtaaaggagacatatccacttttaaaagaatgtaaagacattaactttatcggaagcatcgaagcaagagagattccatccggtgttgcagatgtaattgtaaccgaagcctttgtaggcaatgtgattttaaaattatatgagggagtcggagcgactttgatttctaaagtaaaagaaggtatgatgaccactcttcgcagtaagattggagctttgcttgtaaaaccggcattaaaaagtacattaaaaagttttgacagcagccagtacggtggagcaccgcttctcggattaagagggcttgtagtgaaatgtcacggaagttccaaagcaaacgaagtgaaaaactcgattattcagtgtatttcctttaaagaacaggacattagtgaaaagattcgggaaaatattacagtagcggtgaaaaagacagaggaggagcaataaaaaatggagttagaaaaattacagaagattatcgcagaggtattaaatgtagatgcacaggaagtgacaatggatactacattcgtagaggatttgggagcagattctttggatatattccagattatcatgggaattgaagaagaatttgatattgaaatgccaaacgaagatgtagaacatattgtgactgtaggagatgcagtagaagaaattaaaaaaattgtaggataactaaaagagtcagatgtcttcaaaagggaaaaattcggatgaagacatctgattttcagattgagaagaagaaaattcaggctgaacgcaagagagactttagataaatagaaaaaagtagaagggaagtttgttaatcgatgaagaagttattagagcttgagcagagaattggctataaatttgaaaattttgatttgctcgtaaaagcaatgacgcatagttcttatgcaaatgaacacagatatgaaaagaaagaaaataatgagcgtctggaatttttgggagatgcggttttagagctgatttccagtgattatttatttgcaaagtatccggaaactccggagggtgtactgacaaagaaacgtgcaagtatggtatgcgagccgactttagcattatgtgcaagagaaattccactgggagattatttattacttggaaaaggtgaggatgcaacaggcggaagaaaaagagattccattgtttcagatgctatggaggcattaatcggtgcaatttatctggacggtggttttgctaatgcaaaagagtttattgaccggtttattttaaacgatattgaaaacaaacagctcttttatgatagcaagactacgcttcaggaaatcgtacagggaagttatgatgatgatgtacgttatgaactggtaaaagaagaaggtccggatcacaataagagcttttatgttcatgctctgcttggaagtacggtattgggagaaggaacaggccataccaaaaaggcagcagaacagcaggctgcatattgtgcgattaaaaaacttaagagtaagggtggcctatgtatttaaaaagcattgaagtgcagggatttaagtcctttgcaaataagataacatttgaatttcacaacggaattaccggaattgtaggaccaaacggaagtggaaaaagtaatgtagcagatgctgtacgctgggtgctgggagagcagagcgcaaaacagcttcgaggcggaaacatgcaggatgttattttctcgggaacagaaacgagaaagcctcttggatttgcttatgttgcaattactctagataacagtgaccataatcttccgattgattatgaagaagtgacgattgcaagacggctttatcgttccggcgagagtgaatacctgatgaatggggtttcctgccgattaaaagatgtcaatgaattattttatgatacgggtatcggaaaagaagggtattccattatcggacagggacagattgataaaatcttaagtggtaagccggaagagcgaagagaactgtttgacgaagcagcaggaatcgtgaaattcaaacgaagaaaagcggcatctttaaaaaaattagaggaagaacagcagaatctgacccgtgtcaatgatattttatcggagttgaccagacagcttgcaccgcttgagaaacagtctgagacagcgaagatatatttaaagaagcgggaagaattaaaagcgcttgatgtccggatgtttcttgcagaaatggaacgcatcaatgctcagttaaaagagatcgaagaaaaatcggagattgtccgtcaggacctggaaaaaacaggtaaggattttgagacaacgaagactgaatatgaagcgttagagaaagagctggaggcttttaatgtaaaaattgaagtgtttcgtgaagagtcaacaaaaaaagcactggagaagcagcagttagagggccagattaatgtagcaaaggaacagatttcttcggcaaagcaaagtgatttgcagtatcgtgagcgtgtggaggctttagaggcagagttaaaacagagggaagagagtgaaaaactttatactgaagaaaaggcagagcttgatgcaaaaatcgatgagattcggcaaaaagaggagacagcgaagaatttattcagggattttgcttttgaaattcatgaattagaagaacagttagaggaagataagagcgaaattattgaaattttaaatcatcgtggttcgacgaagggaaaaatgcagcgttatgatgcgatgatggaacagatttcgcttagaaagacagagtttaatcagaaatatctgcgtttaaagagtgagactgcaaagcaggaagaagaaaaggagcgctttgagaaagaacagcaggaaattgatgctgagattttaagtctcacaaagaagagtaataaaaacgaggatgagattaccagatatcagagtctgcttggaaagagtatcaaggaacagcaggttttacagaatgattatcataaagaggcttcgaggttagaatctttaagaaatattacagagcgttacgacggttacggaaacagtatccgccgtgtaatggagcagaagaaacgtgttccggggattcacggagttgtggcagatttaattaaagtagaaaaaaattatgaaactgcgattgaaaccgctcttggaggaagcatccaaaatattgttacggataacgaaacgactgcaaaacagatgatttcgtttttgaagcagaataaatacggacgggcaacatttctgcctttgaccagtatgggtgcaggacgtggattttcgactccgtctgccttaaaagagccgggagttgttggtgtggcaagtgagctggtttctacggaagttgaatatgagagtttaattgaatatctgcttgggcgtacgcttgtcgtggaaaatattgattttgcaattgcaattgcaagaaaatacaaatacagtctgcgtatggtaacgattgaaggagagtctttaaatccgggtggttccatgaccggtggtgcattcaaaaataacagcaatctgcttggaagaagacgagagatagaagagcttgagactaaagttgagagtttgaaaaatcagctggaagcaaaacaaaaagagattgatacttatcgggaaaaacgaaatttccatcgtgaagaagcaggacgattaaatgctgcacttcaggagcagtccttaaaggataataccctgcgtatgaatcagaaagcaatggaacagaaggcaaaagagattgcaaaagagtatacagatttaaaacgggatcttgcagcacttgaaaaacagacgcaggagattgaagaaaatcgggaatctattcgtgtggaattagagacgagtgataaacgagaggcccagttggaagatcagattaatcaaaatcaggaaaaactggatgagaagaaaaagcaggaaaacgctcattcaaaggaattagaagaactgcatttagaaaatgcagaactcagttccaaacagggatttgcaaaagaaaacctggaacgtatcttaagtgaaaagaagaatttacaaagacagttaatggaactggcagcaaatgtcagtgatgcaaaagatgagatagagaaaaaagaagccgagatagaaaaaatgcaggaggcagttgaagctgcaaagacacaggaagcggaagatgaagcgaagctgcaggaataccttgcaaaaaaagagagcatgaatcaaagtcataagggcttctttgaaaagagagatgagctttccggtcgcatgaatctcttggataaagacctataccgcctggaaaatcaaaaagaaaagcttgaggagaatcaggagaatcagataggttatatgtgggaagaatatgagatgacctacagtgcggcaaaagaacagacttttgaggaaccgcttgagcgcagtgaaatcaaaaaggcacaggcagaagtgcgaaatgaaattaaaaagcttggaaatgtcaatgtcaatgcgattgaggagtacaaagaactttccgagcgtcatacgttcttaaatgcccagcatgaagatttggtggaagcagagaagaccctgcttaagattattgatgaactcgatatcggaatgagacaccagtttgaagaaaaatttgcacagattcgtgaagaatttgataaggcatttaaagaactttttggtggcggaaaaggaacgattgagttagatgaagaggaagatatcttagaggcgggaatccgtatcatctctcagccgccgggaaagaagctgcaaaatatgatgcagctttccggtggagaaaaggcactcaccgcaattgcgctgttatttgcgattcagaatttgaagccatccccgttttgtctgctcgatgaaattgaggcggcactcgatgattctaatgtaacaagatatgccaggtatcttcataagttgacaaagaatacacaatttattattattacacatagacgtggtacgatgaccgcggcagaccgcctttatggtatcacaatgcaggaaaaaggtgtatctacccttgtttctgtcaacctaatcgagaatgatttggataagtaagagaagcagatgagaaaatacagaaaagagcaggagggacttatggcagaagaaaagaaagggttttttaaacgactggtatccggtcttacaaaaaccagagaaaatattgtatcgagtattgattctattttcagtggatattccagcattgacgatgatttctatgaagaaattgaagaaattcttgttatgggagatttgggaattaatgcaaccaataatattatcgaagatttaaagcgacaggtagcagagaagaaaataaaagacccgcaggagtgtaaaaaactgctgatggacagcatcaaagcacagatggcagtcggggaggcggcttatgaatttgagaaccgcaaatctgtagtgctggtgattggtgtaaatggagttggaaagactacttctgtcggaaaactggcaggaaaattaaaagaccagggaaagaaagttgtgcttgcagcagcagatacattccgtgcggcagcaggagaacagctgacccagtgggcgaaccgtgcaggggtagaactgattggaggacaggcaggtgctgacccggcatctgttgtgtatgatgcgattgcagccgcaaaagcaagaaatgctgacgtactgctttgtgataccgcaggacgtcttcacaataagaaaaatctgatggatgagcttcataagatttaccgcattatcgaacgggaatatccggaagcttatttggaaacgttagtcgttcttgatggaacgaccggacaaaatgcactgcttcaggcaagacagtttaatgaggttgcagatgtaacaggaattatcctgacaaaacttgacggaactgcaaagggaggcatcgctgttgcaatcgagtcagagctggatattccggtaaaatatatcggagtcggtgaaagcattgacgatttacagaaatttaattcggatgaatttgtaaatgcgcttttcgatttcaaagaagaataaagtttaagtggaacattcgtgaaacctggcaggcgattttaaccaggaagcattgaagctttcgcttcgtgtgtagttcactcagtacatatagtacatgctgaaaaatttcagaatcgccgaaaaaaacagttagatgaacatcaaaggaggatattaggattatgctgacattagaaaaatttgaagaagcgtcggaaatcgtaaagaaagtaacccaggataccaaactggtttacagcgattatttcagtgcacagacaggaaacaaagtttatttaaaaccagagaacatgcagaaaacaggtgcttacaaattaagaggcgcttattataaaatcagtactctttcaccggaagagagagcaaaaggtttaattacagcttctgccggaaaccatgcacagggtgttgcttatgcagcaaaagcatttggagtaaaagcggttatcgttatgccgactaccactccgttaatcaaagtagaaagaacaaaaagttatggtgcagaagtagtcctttacggaaacgtatatgatgaagcctgcgagcatgcttataaattagccgaagaaaatggatatacattcattcatccatttgatgacccggctgttgcaaccggacagggaacaatcgcaatggaaatcatcaaagagcttccgttagtagattatatcttagttccaatcggcggaggcggactggcaacaggtgtttccactttagtcaagctcttaaatccgaatatcaaagtgatcggtgtagaaccggcaggtgcaaattgtatgcaggaatctgtacgtcgcggagaagttacaacacttgacagtgtaaatacaatcgcagatggtactgctgtaaaaacaccgggagaaaaaatcttcccatatatccagaaaaatgtggatgaaatcattaccgtcagcgatgatgaattagttgttgctttccttgatatggtagaaaatcataaaatgattgtagagaactcaggtctgctgactgtagcagctttgaaacatctgcagtttaaagataaaaaagtagtttctatcttaagtggtggaaacatggatgttatcacaatgtcatctgtagttcagttgggtctgattgcaagaaatcgtatctttactgtatctgtgctgcttccggacaagccgggtgaactggtacgtgtggcaagtgtaatcgcagataagaaaggtaatgttatcaaacttgaccataaccagtttgtaagtacaaaccgttctgcagcagtggaactgaagattaccattgaggcatttggtacagaacataagaatgaaattattgaagcactggaagaagaaggatatcgtccgagacagattactgcaaacttatagaacgcaaagacgcagcaatttcgtgcaggcacgctctcgctacttgtcgctggcagcggtacataagcgacaaagtcgctaagtaccggccgctccaaagtgcctgcagaaatttgctgctaaataaaaatgagagggcagaggtataggaaaaaaattgctctttgttagaaaattagatagttaggagaaatcgtaattacaaacgttaagtttttcaatttgtcgctgttagaaaaattggatagttaggagaaatccctgagtttctgtatgtaacatagaagagattcaggggttttcttatatctgaaattgtgcgagaagaaaataatacttattcctactgaaatagtagtgaaataaagagagatgtgttagaattaggacgtcggatgtattttggaatatctggcagggcaggaggtttgttatgagagagttatatttagagtgttattctggaatcagtggagatatgacagttgcagctttattggaccttggtgttccgggggagtatctgatgaaagagttggagaagctgcacttagatggatatgagataaagatttccaggacaaagaagaatcagattacagcgacagattttgatgtgattttgaaagatgagcataaagaggagcatggtcatgaacatgctcatacccacgtaaatgatgaagatgtgaaggaatgtcatgagcaggaacacagtcaggaacatacgcatgttcataatagttatcgtgagattaaggaatttattttggcttcagagctctcggacagagtgaaggaaatgattttaaagatttttcaggtgattgcagaggcagaagcgcaggttcatggtacggctgtggatgaagtgcattttcatgaggttggtgcggttgattcgattgtagatatttcggcagcagcaatctgtctggattatttgggatttgattcgattgtgacttctgaaatctgggagggaaaagggcatgtatggtgtcagcatggaagaattccggttccagcaccggcagtacttgcgatttttttaaagagccagacaagacttcatctttcaggagtgcagggagagatggtgacaccgacaggggcgggaattgtggcagcgctttcgggtgagaatcagcttccggattcttttgtaattgaaaaaatcggaattggagcaggaaagaaagatttctctcatgcgaatgtgcttcgtgcgatgattttaaatactgagaaagagaaaaaggcggtgcatgaacataagcataaatatagtcatgagcaggaacacagtcatacacattgccatgaggagcaggaaatcgaaaaaaaaaagacagctgtaaatgagacaaaagaagaaacgaaaaataaagatgagcagaagggatttcacgatgtccagacagaaacggtatgtgtcatggaaacaaatgtggatgactgttcgggagaacagctgggctatgccagagaggtattgttaaaggccggtgcgctggatgtgtgttgtatgccgctttacatgaaaaaggggcgtccggcatatttgtttcagattatctgcaaaccggcagatgaagaggcattaaaaacaattttatttagagagacaaccagcattggatttcgcagatatgaggaagaacgacaaaaattagaccgtgaaatgataagtgtcacacttttggatggaaataccattcggattaaaaaatgtatgcatcatgaggtgacttattattatccggaatatgaggatgtcaggaaaacctgtgaaatgcgtggtgaggcatttcggatggtttatgaagaggcaagaagtttggccaagaaaagtgaggagtgataagaggtggaattgacgcaaaaagaagagcgattatatgagattatgaaggggtatgcaaagaaggatttatgtattgcgttttcaggtggagcagacagcagcttgttattaaagcttgctgtaaaatgtgcagcacctggggtaagggtacatgcagttacttttgaaaccgtactgcatccatcctgtgatttggatattgcaaaacaggttgcaaaagaaaccggagcgattcataaaatcattttcttagatgaatttgaagatgaaagaattaaaaagaatccgaagaaccgctgttatctgtgcaaaaaaagtttgtttgaaaagctgttggcttatgcagatgaagcaggggcagaaaccatcttggaaggaaccaatgaggatgatttacatgtgtatcgtccgggacttgcagcagtccgggaacttggagtaaaaagtccgcttgccgaggcgcatttaaccaaaccggaagtacgtgcccttgcaagaaaagaaggaatttccgttgcaaatcgtccggcagctccctgtcttgcaacacgtctgccctatggttcagaacttaactttgaagtgctgaaaaagattgatgagggcgaacaatatatgaaaagtctgggatttgagattgtgcgtatccgtctgcacggaaatgtaacaagaattgaggttccggtagctgagtttggaaaatttatggaacaaagagaagcagtgcttgcaaaattaaaagaacttggatttgtttatgtgacacttgatatggaaggatttcgaagtggaagtatggatgtcgatgcccacgacgcttgacgaccacgcagcagatgaaaaatcaggcaagtagtgaagtagattgcgaagctccgcttgactatgcgctgtataagtgtcaagaaaaaatacttgacacttcaaaaatcatgtagtatgataagcaaggtgatgacaagtggaacaatttgtacagcagactttattatacgatttttatggggaacttttaacagagcaccagcgcagaatctatgaggatgtcgtgctcaatgactactcacttagtgaagtggcagcagatttgggaatcagcagacagggcgtgcatgacaacgtcaaacgctgtaataagattctttcagactatgaagaaaaattgcatctcgtagagaagtttgtaaatattaaggaaaaaatccacaggattcacggtcttgcaaaaaattgcgaaagcatcagcaaggaagaactggtttccgaggtggaacacatttcccaggaaattttggaggagttgtagcagatggcatttgaaagcttaacggataaactacaaaatgtatttaaaaacttgagaaaaaaaggccgtctgacggaagccgatgtaaaatccgctttgaaagaggtcaaaatggcgcttctcgaagccgatgtaagttttaaagtggtaaaacaatttatgaaatccgttcaggagcgtgcagttggacaggatgtaatgtccggcttaaatccgggacagatggtaattaagattgtaaatgaagaactcgtaaacctgatgggaagtgagacaaccgaactcgctttaaagccggcaggagagattaccgtacttatgatggtaggtcttcagggtgcaggtaagacaacaaccacggcaaaactggcaggcaagctgaaatcaaaaggaagaaaacctcttctggtcgcatgtgacgtataccgtccggccgcaattacacagttgcaggtcaatggtgaaaaacagggcgtggaagtctttgcaatgggggacaaacaaagtccggttgatattgcaaaagcagcgtacgagcatgcgaaaaaagaaaaatacaacgtggttatcttagataccgcaggtcgtcttcatattgatgaggacatgatgcaggagcttgcaaacataaaagaagcgatttctgtagaccagacagtactggtagtcgatgcaatgaccggacaggatgcggtgaatgtagcagagaccttcggtgagaaagtcggaatcgacggagtcattcttacaaagatggatggtgatgcccgaggcggtgcagcattatcaattaaagcaatcacaggaaaaccgattctgtttgtcggtatgggagagaaattatcggatttggaacaattttatccggatcgtatggcatcccgtatccttggaatgggcgatgtgatgagcctgattgaaaaagcgcaggcaaacattgatgaagaaaaagccaaagagatggaacagaaattccgtaagaactcattcggctttgatgattaccttgaaagcatgaatcagatgaaaaacatgggaggaatttccagtgtcttaaatatgattccgggaattggcggacaggtaaaagatattgaaaatatggtagacgaaaaggatatggcgagaaaagaagcaatgattctttccatgacaccaagagaacgttctcatccggaaatcctgactccacagagaaaagcaagaattgcaaaaggtgcaggagtggatgtggcggaagtcaaccgcttagtaaaacaatttgaacaggcaaagaaaatgatgaaacagatgcctggtcttatgaatggcaagggtgctaagaggggaaaatttaaacttcccttttaacatataaatcaagaagataagaaaagaaaatagttaaattttaggaggaaaaaataatggcagtaaaaatcagattaagaagaatgggacagaaaaaagctcctttctatagaatcgttgttgcagattccagatccccaagagatggtaaattcatcgacgaaatcggaacttatgatccaaatcaggacccaagtgtatacaaagtagacgaagaagcagctaaaaaatggcttgctaacggtgctcagccaacagaagttgtatccaaaatcttcaaagcagctggtatcgaaaaataatataggtccaggaggtggcttgtaatgaaagaattagttgaagtaattgcaaagtctcttgtagattatccggacgaagttgcggtaacagagcgggaagaaaacaatgcggtatttgtagaactcaaagtagcatctgcagatatgggcaaagtaatcggacatcagggaagaattgcaaaagcaatccgtaccgtagtgaaagctgcatcttccaaaaatgataaaaaagttatcgtagatattttacagtaaaagtaaatgagagggctgtacacgttgatgtgcagtccttttttgggcgaaaaagtaaattaaggagttataaataagtatggaagatttattacaggtaggtgtcatcacaaccacacacggaatccgcggagaagtaaaagtctatccgaccaccgacgatgtacaccgctttgaagaattagaaagcgtattattggatacaggaaaagaatacagagaattaaaaattaagagtgtgaaatatttcaaacaatatgccatcttaaaattcaaaggcattgataatatcaatgatattgaaaaatataaagggaaaagcctctttgtcacaagagaaaatgcacaaccgcttggagaagatgaatattatattgcggatttaatcggcatggaagtttacttagaggatggaagtcattttggaacgttaaaagatgttatggaaaccggtgcaaatgatgtttatattattaagacggaagaaggaaaagaagtgctgattccggccatctacgaatgtattttagatgtcgatgtagaagcaggaaagatggaaattcacctgttggacggattagtgtaaaaaaggagaaaaacaaatggattttcatgtactcaccctgtttccggatatggtcagacagggattaaataccagtatcatcggaagagcaataaaagacggacatatcacattaaatacagtcaatatccgtgatttttctgtcaataaacataatcgcgtggatgattatccttatgggggcggagccggaatggtaattcaggcagaaccggtttaccgcgcctgggaatctgtggcaaaaaacagtaaagccataaaacaaggcaaaaaaccaagatgcatttatctgactccacagggaaaagtctttcatcagacgatggtagaagaatttgcccaggaagaagaactgatttttttatgcggacattatgaaggaattgacgaacgtgttttagaagaagtggtcacagactatgtctctatcggagattatgtgctgacagggggagaacttgcttctatggtcatgattgacgctatctcaagatttgtaccgggtgttttaaataatgaagaatctgcccagtttgaatccatgcaggataacctcttagaatatccgcattataccagaccggaaagctggcatgaaaaagaggtgccgaaagtactcctaaccggagaccataataaaattgaagcatggagatgggaacagtctctgatacgaaccaaagagagacgaccggatttactcgaaaaaaataaaagtttaaaagtggcttatttcagcccgaccggaggcacaaagaaagcagcggagatgttagcaacgatgctctcccagaatccggaatacattgatttgacgagaagaaaattccggaaacaaaaacaatactttggaaaaaaagatttattgcttgcagctgcaccggtatacggaggtcagcttccacagttaaaagaagctctttttacaaacttgaaaggggaccataccccttgtattttgatgtctgcttacggaaatcgtgactttgatgatacccttgcacagatgaaagacattttagaggcgagaggattttactgcatcggcgcaatcgcaccgattattccacacatttattccgaaaaactgggggcagaccgcccaaatgcagaagatgagaaagtcttccgccggtttgcagttacagtgaaacagagattagaaaatggattggaagaatccctcatgattccgggaaatccaaatccggaaccaaagaccatgaagccggtggttcattactttgatgaaacgaaatgtaaaggctgtcagacatgtgttcaaaaatgcccgacctcagcgattaataaagacacatatcaaataaaggaagaactctgtgttggctgtctgcgctgtgaaagggtatgttcgggtggggcaagaagcagtgactatgaaagtgttaaaaaatatctggaggacaatttctgtcatccaaaagaagtaagatggtattaaaaggaaaaatgacgaagaaatttacaataatgtggtagaaaatggcggattgactcttgtcttgaaaaaaatagatgatatcattaataggaaaaacagccagatgaaacgaaaagaaggggagttcaagaatactggcaagtacgaaagcgaaggggaaagagaaaaatatgtatctaagagagtcaaaaggttggttcaagcattatgattttattctgctggatttaatttgcctgcagatagccttttttctggcttatgtgctccgtgggatgggctggaatccgtattctcatgtactttatcggaacatggcaatttttgtagaagcggcagacattgttgtgattttcttttttgagacattaaaaaatgttttaaagagaggacactatgtagaatttatagagacactcaaacatgtgctgattgtgtgcgcagtgtcgatgagttatctgtttttgattaaagaagcagaaaagtattcgagatttattctgattacgacaatgtgcttctattttatcctgacttatacagtaagagaagccagaaaatcagtattacaaaaacagatggaagccggaaaagaccgctccctgctgattgtgacgacttcggatgttgcaggaacagtaattcgtgatatgaaagaccacaattatgcgagatttacactttccggaattgcaattattgacaaggatatgacgggaaaagtaatcagtggaattccggtggtttcaaatcgagaaaacacaccggattatatctgccagcaatggattgacgaagtgctggttgtaccgtcggaagatgcagaatatccggaagatttgatgaagaaaatgatggaaacaggtgtaacggtacatttaaatcttgcgaaagtatcgaatacgagagggaaaaaacaatttgttgaacaaatcggaacttatacggttctgacaacaacgatgaattatgcaacagcaagacagctgtttttcaaacgagcgatggatattgcaggcggtttggtcggatgtattttaacagggcttatcactctgtttgttggacctgcaatctacataaaatcgccgggaccgattttcttttctcaggaaagagtcggaaagaacggaaaacgattcaaactgtataaattcagaagcatgtatttagatgcagaagaacggaaagcagaactgatgaaagataataaactcggtgatgcaaagatgttcaagctcgactttgacccacgtgtcattggaaatgaaatccttccggatggaacgaaaaagaccggaattggaaactttataaggtccaccagtctggatgaatttccgcagttttggaacgtgttaaaaggcgatatgagtatcgtgggaacacgtcctccgttgattggagaagtttctgagtatgagctgcaccatcgggcacgacttgcgataaaaccgggaattaccggtatgtggcaggtaagtggaagaagtgatatcacggattttgaagaagtggtagggttggataaagagtatattgaaaattggaatatcggattggatattaagatactgttaaagaccgtgatggtagtgtttaaaaaggaagggtcggtataaagatgagagatttgtgattctgtttaagattggggagatgttaagcagaatcacaatttgtgtatagagatatcttatactgaaaggaaagaaaacgtgaaaaataagaaattacgaattgcagttttaggacacaaaagaattccttcacgtgagggaggaattgaaattgtagtagaagaattatctgtacggatggcaaagatgggacatcaggtaacagtttataatagaagtggacatcatgttagtggaaaagaatttgatgcacataagctgaaagagtataaaggaactcgaatgaaatacgtaccgacaatcgataaaaaaggtctggcagcaatgagtgcttccttttttgcagcggtagcggcagcatttggaaagtatgatgtggttcattttcatgcggaaggaccatgtgcgatgctatggcttccaaaactgtttggaaagcgttgtattgctacggtacatggattagatcatcagagagcaaaatggggaaaactggcaagtacctatattatgcttggtgagaaatgtgcggttaagtttgcagatgagattattgtattaagtgaaggagtacaaaactatttccttgatacctatggaagaaaaaccagatttattccgaatggtgtaaacagacccgttatctgcgaagcagatatgataaaagaaaaatttggacttgaaaaagatagttatattctattccttggaagattagttcccgaaaaaggacttcgatatttggtagaagcgtttaaacaggttaagacagataagaagttagtgattgcaggaggaagctcagatactgatgaattcacaaatgaattaaaagaaatggcaaaaggagatgacagaatcctttttactggctttgtacagggaagagaattagatgaactgtacagcaatgcgtatgtctatacacttccaagtgatttagaaggaatgccacttagtttattagaggcaatgagttacggaaattgctgtctggtttcagatattgatgaatgcgcatcggttgtggaagataaagcgtttgtgtttaaaaagagtgatgtggcggatttaaaagaaaaactacaaaaagcttgtgatgataaagtgcaggttcagaagtataaagatgaagcagcggattatatttgtgggaaatataattgggatgaggttgtcaagaagacgttagagttgtatgagaagaaagggagcaagtaaatgataagggtattacattcggtaagtaatatggatcgagctggtattgagacgatgcttatgaattattatagacatatggatcgagaaaaagtgcaattcgattttttatgtaataagacaaagccaggagcctatgatgaagaaataaaaaaaatgggtggtagaatttatcatacaccgggtttgaatccggcaaaatatcctcagtatttaaagtatatgaaacaactttttgaggagcataaagagtaccgaattgtagaggcacataatggggctctaggcgtgtatgcgttgcatgcagctaaagttaataagattccagttagaatttttcatgcgcacggtgcaagtattacaaaagattggaaattgccgattaagcttgtttgtaagtctatgctacctgcaaatatgaatcatcatttttcatgtggaatagcagctgctagatgttactttggagataaagttgttgataataatgattatgaattgattccaaatgcaattgaagtggagcggtttatatttaatgaaaaagttcgtactgctatgcgtaaaaaatatggatttgaaaataagcatattataggacatgtaggaagatttatgacacaaaaaaatcatgcttttttaatagatgtatttgaagaggtttctaagaaagactcacaagctatgttagttttacttggtgacggagaattacaagaggaaatcagaaaaaaagtaaatgaaaaaggtcttagcgataaggtctattttgcaggtaacgtgggaaatgcaaatgaatggtataatgcatttgatgtctttatgttaccgtcagtttgggaggggcttccagttgttggtgtagaggcacaggcaaatgatttaccatgtattttttcggaaagtgtaacgaaagaaattggtctttctaaaaaggccgaatttttatctctacaagaaactcctttagtttgggcacaatgtgtattagataagttgaaagaatcaaataggaaagataatacgcagttaattacagataataactataatattagctatgaagcaataaaattacaagaaagatatttagaattatacgaggaacagaaatgaaaataggaattttaacacatcattatatcaataattttggcgcctttctacaagcatattctttgcaacaggctgtgcaagacttatatccagatgatgaagtttatattattgattgtattaacttaaaacattttattattaatgcaggtggatggttccgattctataaaaataaagagaatttatctaattggtttcagaaaatacggcttccttggacttttgcgaaagctagaaaaaagtatatgaatctaactcatatttgttatgatgcaaaaggaattgaaaaattaggactggattatattatagtaggtagcgatgaagtttggaattatagagaaacaaaaggaaatgcaaaagtaaaatttggtattggtttgaataatgaaaaacttattgcttatgcaccaagtgttggacaaacaaatgatttggaagtgccagattatgtaaaacaaggaattttgaagtttaaggcagtctcagcgcgagatgctctaacggaaaaattagccgaaaatattagaggagaaaaaatcgagagggtagtagaccccacgttccttagtaaaattccagtagaaccagttgcttccgtaaaaaaaccatatatattattttactattgtgacggacttccagtagaagaaaaaaataaaatttttgaatatgcacaaaaaaatggattggcagtatatggagcaggagagtgtgataagcattatacatctactacggtaaatcttactccatttcaatgggtttggatgtttaaaaatgcatcgtatgttgttactggtacatttcacggagcggtattttcaatgctaaatcatagacaatttgcttgttatcttacgaatccaagcagaataaaaaaagtgacttcgcttttagaagagtttaaattagatagccgctgttgtgatgctaatgcagataatattattgcaaaactaaaagagaaaatagactataaaaggacagaagaagaatttgaaatgcgacgaaattctagtaaagtttttttaaaggataatataaattgaaaagacaaaaagacttgaaagttatatataggagaaaatgatgggaattattctgtttgatgagaaaacaaagtgttgtgcttgtggagcatgtaaaaatatttgtcctaaaggtgcgattgcaatgaaagaggatgaatatggatttctgtatccacagattgatgagaaaaaatgcgttcagtgtggtatatgtaagaaagtttgtgcttatcaaaatggacaagtcaaaaatactccgattaaatgttatgcggctgtaaataaaaataaagttgaattaatgaagtctgcatctggaggaatttttgtagctgtcgcaacttctgtgttaaaagaaggaggagttgtgtttggagctgcattagattttgaagatggacatgctcatccacatcatattgcagttagggaaatttcccagctgtataggttacaaggctctaagtatgtgcagtctgcgattgaaaatacttatgaagaagcaaaggaagaattgaatctaggaaaaaaagttttattttctgggacaccgtgtcaaattgctggattgtatggatatttgagaagagaatatgagaatttgtttacagtggatgtgatttgtcatggagtacctagtgctaagatgtttgatgattttcttcaaaatgaaacaaataagagaaatgttaaaaaaattaaagagtatatttttcgggataaaaaaagaggctgggggatgaatggcaaaatacgatttgaattaaaaaatggaagtgaaaaaactgtttatattcctgctagactgacctcttacaatacttttttcttggatggatttaattatagagaaaattgctattcgtgcaaatatgcgaattcaaagcgaccaggtgatattacgttaggtgattattggggaatagaaagggaaaatccggaattacttaaaaataaagagtatgatatagaaaatggaatatcgtgtattattgtgaatagcaaaaatggaatgaaaataatgcaaaatataataaatctgtcaatgtatgaaactcaatttgaaaaaatagcgaataaaaatggacaattaaaatatccttcgaagcgtccagcaaagagggaacagataatgaagttatattttcagaagggatataggggtgtagatgaatatttttatagaaattataaaaagcagataattgtacatacagtatttaatgcttttccgattggagttcggttaaaaataaaaaaagtattgcataaataatttaggagaaaataaatgtcaaataataatgaattaataagcattatagttcctgtttataatgtacagaagtatttagatagatgtatgaatacattattaaaccaaacttataaaaatattgaaataatattgatagatgatgaatcaccagatagttgtccgcagatgtgtgatgaatataaaagaattgaccagagaattaaagttgtacataaactgaacgaaggcttagggtttgcaagaaatagtggattagaaatagcacggggaaagtatataatatttgtagattcagatgattatgtgacagaaaatatgtgtgaattattatatcaatcagcgaaaaaatatgatgcagatgttgtgtatggtgggattttttatgcggatggtaaaaatataaaagaaagtaaggctgtaacaaaagaaagaatatggaaaggaaataaagaagttaaatctttactgttggattttattgcaacaaagcctcaagaaaaaaaagatacaattatggaggtttcagtatggaaggctttatttagaaaaaaaatttttgatgattataatataaattttgtttctgaacgacagttcatatctgaagatataatatttgatattgattatttatccaaatgtaattgtgttgtagcaattccagagccagtgtattattattgtgtgaatcctaattcattatcaaaagtatttcgaacggatagattttacaaggtaaaaaaactctataaagagattatacggaaattaacacctatttatggaatagaggttgttaataagcgtggagataggtttttaattgcgcgtgctagaacaaatgcaagacagattgtgcggcatgaaaaaattattggaaagaaagaaatgatatcggctttacatagtatttgtgaagatgaagatatgaaagaaatatttagaagatatccaatttatttattaccatttaagtataaattagtggcatatttgatgaaatatagatgctatcatatattaaaaattgttctaggaaggtaggaaaattatgtttacacaatcaaaagatataaaaaaagcaaaattgatgatgtatttaataccgtctgcgcagaagagaacgaagtggttaaagaaacataatgttttttatacaatgggagacaactgttattatcatacaaaagatataccagcagaaccgtatttactttcaatacatgataatgttagagtagctgcaaatgttagatttataactcatgatatgattggagttatggttaataaaatagaaaagttgaaaagtgaatatggacgaatgaaatattatataggttcaatagaagtatatgataatgtgatgataggagcaaattccactataatgtatgatgtaaaaattgggcctaatgcaattgttgcagcaggaagcgttgtgacaaaggatgtgccggaaggcactatagttggaggaaatccagctaaagttattggaaagtttgaagactttgttgtaaaacgaaataaaaaaacagaaaatagaccggagaagacagatggtattaatgacataatagaatatttttggaaagaaaaaacggaagaatagaaggagaaaatgatatggcgattatatatattatttccatggtggtagcattttctttttattttggtggggcacaagttgttttttggtataaatatttaattgcacttctttgggcactttcttatttaggagtttgcatttttaaagaaaaaaagataaagggaaatagtgcgataattataaaaatgtatgtttatccgttgttaaccatattagcatggtcctcctttatttttatatttcattcaccaagtggagctaatattggaaatgttacaagaatggtaagtaatattgtctatttaattctagcagttactagtgctgtttcaacgacatactattttggaaaaaaagtaattaaatattctatatgggcaatttttataagtattatggctaacctcatatattgtatacacttatatggtttaggaatttttctgcaatatttaccacaggcagcgtcaagtacagattttccttttggctcagtattatacaattttgcaagttgtatagaggtgcaagatgctacattggcgacaggtttttatatattatatatgatattgtttgatgaggaagatagtataaaaacaaaattgttctatatgggtctattacttgtttgttcatatttaggatttaaaagaactgaatttattgcagtaatatttacagtaatagttatgtggataataaaaaaatatgcaattgatttatcattaatgattaaagtaataggaattgctatattactgtttagttttggctatatatgtattgtaaaatgggacttatttcaaacaataatagataaagtgggagctaatgttacagggcgtcaaaatgtttatcgtaatttagcaagatattatgaaatatcaccgctttatattggaaaaggatttacatttgttgataaaacaatgtatgatactacggggttttcagcacataatacagttgttcgtatgtacgctgaattaggatttattccgtttattatttggattgtttggtatttaattcgaattcctttgaaaatattaaataaatttggggaaaaaaatgcgttaattgttatgacaagcacattgtatctattttttacatattgtataggaaattctatgaacttttactgcatacagtatagttttatattgattacagtagctactttcgatagtaatgggaaattgaactataaaaaaattaggtttaaaatataatcaaggagataaaaatgcagttatttgatgataaggggaaatgctgtggatgcggattatgtgcagctgtctgtaaaaaaaaagcaataacaatgaagatggacaatatgggatttatttatccagaaatagatggaaacttatgtattgaatgcggaaaatgtgtaaaaatatgtagttacaataatcaagaaaaattttatacaccaatagaatgttatgcagcattagcaaaaaataaagatgtattaagtaaatctgcgtcaggaggaatatttgcgacaattgcaaatcaatttattgaatcagggggatggatctgtggagctgtcatggattttaaagatggacgagctttttgctatcatttggtaactaataagcttgatgatataaaaagaatgcaaggctctaaatatgtacaaagtgatattacggatgcactgttaaaaataaataaattgattcaacaaaaagaaaaaatacttttttgtggaaccccttgtcaagtttcagcgatacaaaaattatctataaattatgaacagttatatacaatagatattatttgccatggagtaccttcagtacatttatataatgaatttttgaaatgtaaagcatctaggaatggagaaatttgtggctttttatttagggataagagcagaggaaaaggatttaaagcaaaaattatagaaaaaaaaggcaaggaaagaaaggagagaatgtatccagcacatctgttatcatactatcattatttcttaaagtcattgatatatagagaaaattgttatacatgtaaatatgcaaaagaaacaagatgctctgatatgacaataggagattattgggggatacagaaaatatttgagaaaaaaatagaactggattttgaacagtcttggtcatgtgtaataattaataatataaaaggaaaagtattattagaagaaacaaaaacatcatttgatttggtacaaactcaattaaatgatataaaacaaggaaatgctcagctaagtagaccgagtcaaaaatcggaagaacgtgacaaaatattgaaactctttgaaaaggaaggatataaagctgtagaaaaagattttaagagaaaattaggattgaaatactatggattactattgagaaattacatgtttggtcgataggagaagctatgaatagtgatgaatcaagaacaaaaaaatcaataaataatataataggtggtttaatgtttaagctaatagcattattcttcccatttattattaaagtagtaatgataaaaaaattaggagtacaatatttaggattaaatagtttgtttacttctattttaatggtcttatcattatctgaattaggtgtaggaagtgcattagtttatagtatgtataaaccaatggcagaaaataatatagatagaatttgtgcattattaaaaatttataaaaaattttatagaataattggagtggtaatttcagtaataggattaatgctattaccatttttaaaatttttgattaatggaacatatcctaaagatgttaatatatacatattatatttaatatatttggttaatacagcactaagttattttctgtttgcgtataaaaaatcattatgggaagcatctcaaagaaatggaatagaaagtagattagctgcatttacaaatgcaggtatgtatattgctcagattttagcattattatttacaagtaattattatgtatacattatatttttgccattaagtactctgattcaaaacctgataagaagtgttatggttgataaaatgtatcctcaatttgaatgtaggggagaactagaaaagggatttattaaagaattatttaataaaatcaaagctttattagggcataaaataggttcaactgttataacagcagcagatagtattgttatttcatcaatcttaggacttgaaatattagctatatatggaaattattatcagattattaatgcgttaattggagtagttagtgtaatctatacggcaataactgctagtattggaaatagtattgtagtatctgatgataataaaatttattctaattttaaaacgttaacttttatgaatagttggctggttggctggttttccgtatgtttatattgcttatatcaaccattcatgaaaatctggatgggagaaaaaatgttgtttcctaattatatggttatattatttgcaatatatttttattcttggttagttagaagaataggactaacctataaagatgcggctggtatgtgggaacaggatttttggaaaccatatgtgggagtagttgtgaatttagttgtcaatattatattatgtaaaattataggagtagctggtgtattaatatcaactataattgttatggttgttatttattttccttgggaaacgtggtctttatttaaatatctttttaaaagaaaaccaggagagtatttgctaaagatgtttatgtacttagcggtaacagttatagttgctcttgttactgattatttgtgtaagtgcataaatatatatggaatactagggttgatgataagaatgctgatatgtatgttagtacctaatattatatatttaatggcatattttagattaccagaatttcaggatggaaaaaaaagagcacttaatttaattagtagtaagaaaaaatgatataggagacagagtgaatgaataagaagaatatttgtattattacacaatgttcgttgccaattccaacaactaaaggaggagcagttgaaactttagtggaataccttttgacagaaaatgaaaacaaggcgaagtatcattttactgtggtaagtgtgggagataatcaagctgaaatacaatcgagacagttcaaaaatgctgattttatatatataaataaatctaatgaattattgaacagattattatttcaaatatatagagtgttaaagcatgtgaatatttatattccattttcactagaatttaaaaaatgtctccaaatattaagaaacattaaaaaccaagatttatttatttttgaagcaggtccgacaacacagttacctgctttaagcaagattattcctaaagataaattactggttcatattcactgggatggaatgggaaataagcgaaaagataagtgcttttcttacttgataccagttagcaattatataggagaacagtggaaaaagaatacaggatgttcagatggaaagataaaagcattgtacaattgtgctaatatagaacgatttgaaaaaacaactacggaacaagagcaaaaagaattaaagaaagaattaggaatagcagaagaaaataaagtgattctgtttactggaagaatagtggaagaaaaaggtgttcgggaactattacaagcatttcagcaaattaaatataataatgttacattattgattattggaagtgctaattttggaagtaagacaaatacaccatatgaaaaagaagtatcccaaatcattaaaaaatcttctaaacaaattgtatttacaggatttgtacatcaaactaaattatataaatattataatatagcggatatagctattatgccgtccttgtttcaggatccagctccattggtaggtattgaatgtcaggcaacgggtactccattaattgcaaccagagtaggaggaatcccagagtatgtaacaaaagaaacagcaatattaattaataaggatcaagatatgataaaaaatttagctgataagatagattttttattaaataatcctgagattatgaaaaatatgggagaaaaagcaaaacaaaatgcaaaaaaatataatacggaaatgtattataaacatttttgtagactagttgatgaaatattataggaaagagaaagacgaaataatggaaatagcgatattatcaatgcaaagagttatcaactatggttcggtattacaggcatattcactaaaaggtattattgaagatataacaggagagcaagtagattttattgaccctgtccttgaaaatactatggctgtagatatgccagttagggactctgacgattatgaaaaaaaagaacagtatggtatgtggttaccgagaaatgttaaaaaggctttagataaaataaactataaaaggttgacaaaaaaaattataaaatttcaggaaaatgaattgggaatatcttatagttatgatccgcacaagaaaaaatatgatttggtaattgagggaagtgatgaagtttttaaagcttctgataaaatttacttatacatgtatggagcaattaataatgcaaatactttaattacttatgcagctgcatgtggaagtgcatcaatacaagggttgagtgaaaaaaatcgtacgatattaaagagtctaatgacaaaatataaaattatatcagtaagagatttacatacatataactatgtgaaaaatttatatgatggaaaagtggagcgacatctggatccggttttagtaggggatttatacaaaagaaaacataatccagtaaaattaaaaaagtatatgattgtttatgcatatggaaatagaattcgagacgaaaaggaaataaaagctattaaaaactatgcgaaaaaaaatggcttacaaacgatagcggtgggagcaccacaattttggtgtgataaatttttagtagcgtcaccacttgaagccttagattatttttattatgcagattatatagtaacagatacatttcatggctctattttttcggttattaataaacgtaattttgcagtaatattaagaaaaagcaataaaaataaattagggggattattgagagatttggatttagaagatagaattatagatgatatggataatcttcctaaaatattagaaaaggacattgattatgcaaaaattgatgctttattgaataaggaaagagtaagaactagagcgtatttgacagagcagattgaaagtattgagtgtaggtagaagattggtgtaaaggtatagtctgataaaaatataatcaaggagaggctgaatgcatttaagaaaattgtttagacagttgttatcgcttcctaaaacagtatactttaattttaaagttttagagttaaaatatgcgattaaacttccattttatatagataaagatataagatttggaaagctatacaaggatattgtgaaattaaattttgagccaaaaagattttcaataaaattcggagaacaggtagtagatgggataccagaaaatacaaaaggatatgtgtcaatgtcaaaagactcgtgtatagaatttgatggatatgctgaatttgcatatggaatttctttttatacgaaagaaaacgcatatattaaaattggctctgatttttactgtaataaaaattgcgtcattgctgcacgcaaatctattaaaattggaaataatgttcttatgggatggaacattagtattatagatagtgatggtggtaatcatttggtatatgaaaatgatgtacttaaggaaaataaaaaagatattatattaggaaatcatgtatggatatgttcatgtagccatattatgaaaggggttactataccaaatgatacaatagtggcatataattcgtgcgttacaaaatcttttagtgatgaaaatagtattattgcaggaagccctgcaataatagtaaaaaggaatattaagtgggaacgatagttatataaaaaaattaatcataaaaaggagaaaacacaatgacaacaaccctagtaatcatggccgcaggtatcggttcccgcttcggcggtggaatcaaacaacttgctccggtaggtttaaacggagaaatcatcatggactattctatccatgatgcaatagaagcaggttttaacaaaatcgtatttattattcgtaaggacatcgaggatgccttcaaggaagcaatcggtgaccgtatcgaggagacctgcaagaaactgaatgtagaaatcgcttatgcatatcaggaattggatgcgcttccagagggagtagaacttccggcggaccgtaccaaaccttggggaaccggacaggctgttcttgcctgcaaggatgtgcttcatgagccgtttgcagttatcaatgcagatgactattatggaaaggaagcatttgtgaagttgcatagttttctggaaaattatacaccagagaaagcaaatgagttctgcatggcaggctttatcctgaagaatacattaagtgaaaatggtgcagttaccagaggagtctgcaaggtaaatgaagccggttatctgacaggtgtagatgaaacttctaatattgtaaagatatcagagggtgcagctgtggaaaatgacggtgtgcttacaccgattgatgcagagtcttatgtttctatgaatatgtggggcttaacaccggagtttatgcagactttggaggatggatttaaagaattttttgccaacatgggagagaagaatatcttaaaagcagagtatctgcttccgatttatattgatgaactgcttcaggcaggaaaggtatcggttaaggtgttagactctcatgataagtggtttggagttacttataaagaagataaagagtatgttgtgaaatcttttgcgaagctgattgaagatggtgtatacgaaaaacagctttttggagatttaaaataataagacgagaaaaggggcagaaaaaacatgacattagtaaaaagtatcctgacaaatattcttactgcgttgtatcatccattctggtttgcggtgatactttctgtgtttattctgtttttttatctgtatgcgtataagcctgacaatgccggaaagggaataaagcaggtttgtattgcctggattttaaattttaagcagtcttctttttttagaaggctgttttgccttgtgttttttacagtcatgattcttttccagacgcttttaaatcgaaacctgtgggcaaatccattatcaaatgtcatgggcggatggtggatttggaaaaaagctgcggatggaacagttactttgacaacagaatgttttgaaaacattgcgcttatgatgccgtttacgatttgcctcatgtggacagcgaaggaaaaggtcatcctgaaaaaacgagatggacagataagaaataaaatctggtttggctccattatatgggcatgtggaaagacagcatttttgttttcagtttcgattgaatttttgcagctattccttagacttggaacgtttcaactatccgatatctgctacaatactttaggcggagtgcttggtggaatcatttactggattgggtggaaactaaaatgtgaacttccgaaaaaatctgctttaaacaaattccaggtctgatatagtggttcagggagacaaaaaactaagctttttataatgaactgatatatgtaattgggtaggggggagaaaattccccttaccctgattttttgagggctgattaaattaacatgaaaatatgaaagataaaatatggtaggtagaccgtaaacggtgaaacgagagtaccttgacgaagataagaccgcttttgcggtccaatcattcatcacttgttttctttggttttcggatatgctctggcagtgtttttgaccaaggcagtaattcttcaaggaaacctgtatttttatcttccgcatattttggaatctctgtaagcagatatccaaagtagtcatacggcttcaagttattcgccttggctggcaagacggatggaacttcgggttttggatgttcgctttgcagacgagacggagatggaacagctttactacaactacggcgaagcgcatctgctggatgacagtggaagaacttatgcccagataatccgaaccggaacgattctgatcaagtttgctttgtgccttgtacagagtgtatcaatagcctatatatgcctgctcagaaatatgaaagaaaaatcacttgcagtaatagcttgtgatggcaaggatactatgtctgtccgtgtacctgatggatttctgggattacatagaagttttaagatacacagtaagcaattcgtgtacgaaacactgatcggatggggattaaatccagaaaagacgtattcttttaaaggggagtatctggaggaacaaaaaatggtagtattttacctgaaaaatgattaaagattggaatatatagaagaaaatttattattagcatgaatgatgttggaatagtattgatgaattaatttgcctatgttaccatctaactatataaacagagacaaaatgatattaggggtggtaattatgagtttatttaatattccagacggtgtagatgttatagaagttagaaaaaaagtgaataaaatgctttctgaagcacgaaaaaaagcaaaatcaaaaaaatgtatattgtgtggaaaagaacaaagcagtttttgcaattctcattctgttccacaaatgtgtttacgtccgattgctgataagggaaaagttttacacgcatcattggcaatgggatttgatataggagtagtagatttggatggaggtgtaaataaatccggcacatttaattatatttgtagggaatgtgatgcgaaattctttcaggattatgaaaatccagataatataatacaaccgccaacagataaaattcttgcagaaattgcagtaaaaaatatgctgttacaattaaataaacgggatattgaactagagttgctggatattaagcaacaggagcttggaatatatgaaaatccagataagttatcagaattaaaaactttggatcaaaaagaatatcaagaagaagtattgtttcatcaggatatagcaaataataataaggaaggcggataccagattttgttttgggaggttctgccatataaagtaccaatagcaactcagagtgccatggtattaccatatgatatggaaggtgatatacttaatgacgtgggtaatatggataaatctgtgaggatgcaatatgttcatatagcggtattaccgttggagaaaaaaagtgttgtattggcattttatcataagagggataagatttatcgaagattacgacatcaaataaatactacttcacgggaaaaagtattacagtatataaattatttaatatttgagcatacagaaaatgtctatttttctaagacaatagaagaagaattaaaaaataataagatgattgaaaaagtgagtcaggaagcaaatgggcttcctacatttggacatttgagtgtcgataatatctttggaatggattatgaggctgtaaaaccagaagatatacctaattttttagatgaaagttgggctattaaagaagaggaaaatacggatggggaagaataacagcgtaaagaaaatagatgaagaacatattttgaagagatttgaatacactgttcgagaatatattagattttatgatttttacaagaatcaggaaatgagcgaagaaaatacagaagctttttatgttatgttgcagactaaattaatgattcttaggaaatacgattataatagggaagatgtatatttaagcaaggtatttgattccattgataagatgtatccagaattgaaggaaaatgttagtatgcttagagaacggtttgagaagcttaataattattatatggaagtaattttatccgatggaacgagtcttaatctttataaagctattgaggatgtgatgtatggtttatatttacacgcagatccagataaaatagaaagattgctcaaaacaaataaaaatgtatatcttatggctgtaaaagaatatattactgttttggaaggaatagttgttgatacatataattcaatagttgataaaatgcaaaataagtatatccagcaagaggaaacaagtgcatctgtaatttttatgggagatccaacaaatgaaaaacatgatataaaaaattcaccgtattggaagaatctatatggaagagatttggaagatacagaaataaaaggtatatttcaggatatgtctgatgaagatatagagatttatctgaaaggtactatattcctccaagagataagcaaggaaagttattcaatcaaattgttagaacaattagtgtttccaccaacaaggagtggctggggagatttctcgaacttgcatgattttgttataaataaaaagcatataggattaagtagtaggattaaatataatgatgaacataatattgcacatttgaagatatgtcaaaatgttgaaaatgcttttcttgtgaatcaaccacaccaagtacctgatatttgtacattaagttttgtgaaagaaaatgaaaaatatggatggagaatatttcaaattggagaacctgtgattaaatacaaagaatcaggaagtataatggactggataaaatatatcaaagaaaataaacgtaagagaaagtaaaatatgtgcggatacagtccttgtaataggggcgtattgatgttaagatggtagtatagaagatgtaaataagctgagaaaagaaggtgttaccaatgaatgaggaagaaagatttgattttgagcaaaagcacgaagaagaccttcaaagattacgtggctttcgtcttttagatgatgattttatgagcaaagtatttgaagataaggattgtgtggaatttttattgcagattatactaaaacgagatgatcttaaagttacaagtgtgagcagtcaatatgtaataaaaaatctacaagggcgttctgttcgtttggatattctcgcagtggatcgacaaaatcaggtgtataatattgaaattcaaagagatgataaaggtgcaggtgtgaagagagctagatataatagtagtttgattgatgcaaatgtaacagaaccgggtgaacaatatcaaaatttgaatgaaacgtatgtggtttttattacagaaaatgatgtgttaggagaaaatcttccgatatatcatgtggatcgtatcatcagggaaactggaaaaatgttcaatgaccaatcgcatattatatatgtaaactctcagataaaagatgaaacagcattaggaaaacttatgcatgattttacatgtaccaatgctaaagatatgtactatgaagtgttggctgaccgtgtacattattttaaagaagatgagaaaggagtggcaattatgtgtaaagctatggaagatatgagaaatgaagcagcaagagaagctgaaaaaatgaaagcaattcgtatggctcgtttaatgatagaagatggtaaacttagttatgaagatattgcaatgtacacagagcttactctggaagaagtagaaaaaatagctttggaaaagaaaagtgcataataaatgactcgaaacgaatgttctgtcttttggagcgataagtagaaaagggcttctgattatttataaaaatcagaggctctttttatgcctaaaagttgtttttgagttgacataaggaggcgatatgagcatcgtgggaacacgtcctctgttgattagagaagtttccaagtatgagctgcaccatcgggcacgacttgcgataaaatcgggaattaccagcatgtggcaggtaagtggaagaagtgatatcacggattttgaagaagtggtagagcttgataaagagtatatgccatctgggagcgggagcggcgcagagatgacctgtctaaggttcatcattcaatcattaaatgcagaagaactatttaatattaatacaatgcagtatgccgaagattccccatgatacatatatcaaatacgtttcatggggagttatttttatgcatttagattttcaagttcatgaatggacaagtcagtaaaatgagcaatttcttcaatggttagtttgccggaagatagcatacgcattgcagcttttacagctgtttcatgtgaactttccaacagcatcttttctatttcttcacacatggaaaacctccttttgctgattattcagcagattcttcagaagtagagctgttcttttttcgggactttccagaaatcattttgtgaccagaatagatagccataatcatgcagagaagagagctgcaagcaaaatatttatgtgcagatttcatatctttataaccagtgtaaaaagttccgatcatggttgctaatgcaccgagtgaccaatatttatgtaacttcatcttaatacctcctgtgctttttctatatcatacatctttttaagaaagatgcaaacaggaatttattcattggcttatatttaaaatgatatttttgtgacttgaaaaaaagatagagattaagggattataaatcctggttcttttcaatctgttgttcctgctcacgattcttctcaagaatcatatcaatattcgcagacacagtacgaagctcccgttcataattccggcggttagaaaaatcttcccgttgcatatctcgcaattcaataagtcggtctttttcagcatagagggctttcatggaaggtagcttatttccgacagatttttctttcagtgttcggagagctgtatcataaagagaaagctctgcccggtgttcttcgtagaatttatctttgttacggctcttacgataatcagcatacacatttttatatgccaggtattgtccggtaaaatgaatctgctcattcacatttctaagttgctgttctgtatcctttaaagattttctggaagcactggtctggtctgatgcctggtcaagtactgcatgaaaatcatcaagggagtcataaccatgttcctgtatgtaggcaacagtctgagctatctgcttcaaattggtgagctttactttttgagcataggcttcgcttggctgtgctttaatacaggtttgcagatctatgacaagtcggagatctgattttatgaaaatgaatggtgcagggatggcagaagtatcagagaaaggaacagttggtaaatctgtggaagtattcggagttggttgttccagaatttcttctttcagttctctatgggatttcgtgtttttctcaaatgctttcaagagaaaatcttctgtatatctggttccgagattcctttggagtgattccatatagcataaaagaaaaaagcgaaaaaatgttgaaaagaccgaattatctaactgttctggtagtgttaaaagtaatgatacgtcagattgacggagtttatcgtctggatcatgtttaatattatatgaaaaagtgtttggaatcatcttgataatatgttgaatacgacatattataattataaagaggaaggagcatactaatgtacaagatcattttatatgatacagaagatggaagatgccctgtgcaggaactattagattccctggagcctaagttgctggcaaaacattgcggacaattgacttactggaaatgaacggtccattacttcgtgagccatattcaaaaccattggagaatgggatatttgagtttcgtaccaagcagggatcagatattacaatagtactgtatttctttattataggcaagaaggcgatactgaccaatggatttataaaaaaatcgcagaagacaccaaaggcagaaaaagaactggcaaagaagtataaagcagattatgaacggaggtatggcaatgagtagctataaagattataaaaaaagagcattgcagaatccggaggtaaaggcagaatatgatgcattgcaaccggaatatgatattatccaggcgatgattgatgcaagagtgcagcagaatatgacacagaaagatttatcagctaaaaccggaattacgcaggcagatataagccggatcgagaatggaacaagaaatcccagcctgggtatggtgaaaaaacttgcacagggattagggatgcaattaaagctggaatttgttccaatgccaacaaaaaataaaatgtaaagagtatgagaaaataaaaaacgcaggaattttcacctgcggtttttctctgccctgccatatacagaaataccgccatagaaatattgctatactatgacggtattacaaatgcagtatataccaggtgaatattacattacccaaacttagtgatgaagaaatagctcagcaagataaaagagtgatacaggagttgataaatcaggcagagcatgtttacataggaaatagtgaacgagaaggtaaaaaaagtattggacataagatattatgtttttaaatgttatattatgaaaggattaaatttattgatggatttaggaaaacattgactggctggggtctgaatttggaaaagacttactcttttaaagggaaatatctggaagaacagaaaatgtttgtttttggtataaaggatgtagatttatagaagaatcattgttgaaatattttccttgtgataatataaatatagatgtatttagagtgatggaattacaaaattaaattgtacaaggagaacatttatgaacattcaggaattgacaagacagatgataatagatgaattactgatgattggctgtgtcgctggtcatatgggggttgctgaatttgtgcgaaaagtatatcctaaggcgaatagtttgcctacgacggatcacagatttggaatgacaacggctatagatgatattcggcaacacatggatcgaaataatgattggagttttgaggaacttttttattcatatcttgattttttgaaaattaatgatgaagactttaaatattttttgacacagtatgtgcatccatctattagaagatttcaaattaatgatgaatatgaaaaaatttcctttagcaattctgtttgtgctgaagcaataaacaaatatttaacttcagatggatatgaacttaaacaaatagacacaactgcaaatatgccaatatatagtgtggttcctttgactccaggagtaaatggaaagttgaaaaatattatttttgcttctaaatacaaaccagaaatcgttttgtcagatgctcttaataataatgtgactattgtaaataatgcagatcaatgtcttgtatatgatgaaccaatagggggacatggaattacatggaaagaacttcaagactggtatgataacgggttatatgagctggatatggtgacattcatgaaaaattcattgggggattccccaatggaaaaattgttttttgatacatatttagaaatggtagcagggagagaaggaaaaataccagcattgtttcctcaggtatggctgtattatgatccaaagttgcaaaaagatagaattaaaaagatttttgaacatcagcgtatggatttccttatgcttttttctgaatcacaaagagtggttattgagattgacggagtgcaacattatgcagaatatgttaaaggtaataaaaaacattatgcatcagttgataaatatgctgatatgatggcagcacaacgagaaatgagtttggctggctatgatgtttatagatttggagcaaaggaattatacaatcttactattggaaaaagaaaagtgtgtgcattttttgatagattattttctaaatatggtatatcagtataaagatggagatgtgtaatgacttttcaacagtggttcgataataattggcattctaattgttttacgattataacggaatagtatcaggaattatttcattagttgttttagcggcatattatcatttttgtatacagacacaagaaaggtattatcaatgaattaaaaattaaatgagaacgagttttgtcagaatcttatgaaaatgcttctaaagaaatactataagtatgaggggaaatttatagttgaaattgataaaaaagcagaggctgagtttgcttaaaggaagttaatcttaataaatgggcaatatagcattatgtgaatcaagaagaattaaaaaaataccatatcattgagaataaaaggtaaaagtagatgggaataagaataacgagtgcttcaacaccgataggcggaatttcttgggaatttacagaaacaaagaaaaaaggaatcaaagatttattcctttttcttgaatcaaaacgaattttggttaatccaaaagaaatggaggttaaggaatggagtgaacaatcagttatagaaataaaaaataaacttgtatctatagcaacagaatatgagtattctcaaaacacgatggaatgtttcaagatgatgatagacacctgtaatatttttttggataatatgcatcaagttaatatatcaggaatcatctataagaatcaaaaaggagattggattcatagtggctatgcttctgctatgaaggaatttcgtaaatcttttaaatataatatacaaagactttcagaggaatatcaattaactttttcaaaagaaataccagaagaatattgaatagtatctttgaaacggcggttagttgatgttaagatgataataaagagagaaggtgttaccgatgaatgaaaaaagtagtcttgatttcgaacagaaacatgagaaagaccttcatggattacgtggttttcggcttttagataatgattttataaaagaaagatgcacaggtggctctgaacagaaaaatgaattgccagaaaacagagaaaggatttttgtttaaaggaatgctttccatgggatttttttacggtttgttgcgtaccgcttactaagaaactccctacaatatacatcatatatcaaataggtcatgtgttgtagggagtcattttttgttatgccgttttctgtacagccagagccttgatttcttctaaggttaggtctgtaaaagcggcaatatcttcataagtgagtttgacggagaccagcatacgtttagcaatttcaatgcgttcagcttttcgcatattttccatttctctgcacatagtcaaaactccttcctcatcttctttaaaataacgtaccctgtcagcaagcattttataatacatatcttttggaacggtacaggaaaaatcgtacattagttttcttagttctgtttcatctttgatttgggaatttacataaataatatgagcttcatcgccaaatggttcaccggtttcttggatgatgcggtcaatatgataaattggaagcccggcttttaatacatcattttcagtaataaaaatcacataggtttcagtgagggcatcatatttatcgccagtttcagttatattggcatctataagactgctattatatcttgcacgttttgcaccggcaccacgatcacttctttggatttctatattataagttcggttattgttatcgacagctaatatatccaagcgaatagagcgtccttgtaaattttttatatcgtattgtccctgtgcagattgtactttaaggtcatgtctttgcaaaataacttgaagcagaaattccgcacatgccttatcttcaaaaactttactcataaaatcatcatctaaaagacggaatcctctaaggcgttgtaggtcttctttatgcttttgctcaaaattcagtgtttcttctgtattattcattgtaaaaacaccacctgctttcctttagaatggaatatagtaaacatgaatttctatatcattattttaacatggcaaatagtaatcctcaatacctgaattttgaaatgacaaatgtcgatgaaaaataacagcctatgacggtattacatatgcagtatataccaggtgaatattacattacccaaacaggcaggacaggagaatttagcctaattgttcgggtgaaatcctgcatttaggggatttattttcggaagttcacaaggcagaaaataatctgaaatttacaattctgtcgttgctaagcggtagaaaaagagctatacttaaattgagaaattatactcaaaggagatatgctctatgagtgaatataatatcgatattgccgatatgcagtgctgggtctttcggatggctcaatccaagtggaaaatgtctcccagcgattgcgcagagctgtttaagaaatacgacattctcggatttatcgccgactgctatgacattcttcatttgaatagctacgaatgtgctttgcatgatgttgaaaccctgctcaagaatcgaggtgttaccgtatgataggacttgaagatggaatgcttctctaccacggaaattatgtcagtattcctaacatcgacttaagtcgctgtatgggtggtctcgattttggtcgtggtttttatttaacctcatcttatgaacaggcatacaactatgtccagctttctgttcgcaaggcaaaacacatcggtgctgttccaaaaaactttgatccagctgacggacaaatatccgtctacaaatttcactatgatccaaacattctcgcttacttttttcaagaaaccagtattgaatggctacattttgtagcagccaatcgaaagaaagacctctttcctcagctcctgaaaaaatacagcgtaattgatatcatcggtggaaagattgccgacgatcagacagcccgtacccttcagatttatatcagcggtgaaggcgccggtgagcctggaacttcaaaagcagacaaagaaacgattgaaaaacttttaccaaaccgtctcgaggatcaattttgtttcagaactcaggatgccgtcgagcatcttgaatttataaggagtgaccgctatggcgacatcaaattgtgataatgctataaactataaatctacagattctcaaaaggaatgctgcgcagtaattgcgatgcgcgaagctgtagaaacttttgctgcacgagaaaagatttcttacgaggaagctcttcttcgtttcacaagttctcgtgtgtatgaagccctctttgattttgacacagagatttggaaagaaggctctgattatctgctgagtctttatgattattgcacttcaaaaaagactgcataaaagatatcatgttcgtaagcgatgaacatggaagcatattgctccataagccacatccacaaaaagaattaaaagcctatcaaatcaaacagctgatagagattttggaacaggtggtctcatatgaaaaacggaggaaagagagttatgttcgatatcattcatcatattgcaattattggaagcgattatgaaaaatcaaaacatttttatgtggatctgcttggatttaaggtaatcagagaaaattatcgaaaagaacgtgatgattacaagattgatctggcatgtggaccgcaggaaatagaacttttcatcataaaaaatgctccagctcgtgtaaattatccggaagcattgggattacgtcatctggcatttaaagtggagagtgtagctgatacagtaaaagaattgaatgggaaaggaattgaaacagagccggtacgactggatgattataccggaaagaaaatgacatttttccatgatccggatggacttccattggaaattcatgagtagaaaatagcatagaatagaaagagacagatgcaggtaatgaaatactcctacatctgtcttttttgtgcaaagatttatttatcggaatgtcgcaaacagctttttataaaaaataacaaaatgtaacgtcgataagaataaaagttgcagtttatttgctaaataaaaatttttattaaggaatggtaaaccttgcaggcagatgaatggtaagatataatcagtatatatttagacgaagaaggtgacgcagtgaaagtcgattttatagaattaacaaactttagaggtattcaaaaacaaagaatcacatttgaaaataaaaattttgttgcgttgataggagacaatggtagtggaaagacaaccatactcgaggcaattacaaagggatttgtacccatattaagaacagttaatgcagaagcaatgaaagagtgtgatttggcaaataatgatataaggaatggagctaatggagcagcagttactttagggataacgttagatggcgaaaaatatgtctggacaaatagacgtagattatcatcgcagcagccgtttgaaaatgcaggagatgtaaaagcggaaaatgcaaaatctttaaaagaattgaagtccaggtattcacaatgtgtggaagagagaaagctgccattgattctttattatggaacagacagaattatatgagaagtaccacagaggggacatataaaaaactttcaggtaacagatgctttaagaaactgttttgataatgtcaattattttagagacttttatgattggttcaagacagaagaggatattgaacttcgaggaatccgtgaaaatccagattataagaatccaaaattgaattgtgtaagaactgctttggaaagaatgataaagggatattccaatttaaggattgaattagcaccgtcaagaatggtaatgacaaattcagaaggggtagatctccagattgatcagttaagtggaggatataaagcagttttatcggttattgcggatattgcaaagagattatcaatggcaaatccagactcattgaatccattggaagaagaagctgtgattttgattgatgagcttgatttgcacttacatccaaagtggcagaaagaaatcgttgctgatttaaaaagaacatttcctaatagtcagtttattgtttctacacattctccatttatcgttcaatcattggatgctgacgaattatttgatattaaaataatgcagtatgcagaagaaggcaattacagaggatggagcatagaagctattcaggagcataagatgggtgtagaacctaaaaccactattttcaatcagtatttagaagaattttcagcagcaatggatgaggaggattatgaaaaagcaaaaatgctttacgaggagttaaaggaaatggtgagtccaggaagtaacgaaagtaagattttaaaactggatattaagattggtataataacaagactcccacatgattatttatattaagcatatttcatggggagtcatttttatgtatgcattccgattacataagcatagaagaaaaatttcgttatttttcagattgtgtagcagcttcttcagaaatagaatctttcttttttctggatttaccagaaatcattttatgaccggagtagatagccataatcatacagagaagagagctgcaagcaaaatatttgtgagcctttttcatgtttttatagccggtataaaaggttccaatcatcgttgtcaatgcaccaagtgaccaatatttatgtgctttcatttgaatacctcctgcgtttttctataataatacctctttttggaaaggatgaaaacaagaaatttataaattttattctttctcaatctgctgctcctgctcgtagctcttctgtattgaagcaaatgagaaaaatacgcctttgtgtattaacaggtttcctgctttcgtgtggaattgagataagtcagcttatcacccagcgagggtactgccaattagatgatgttgttacaaatacagcaggaacattaattggctggacaatttggaagggatttggtaaaataataaccataaaaaaacgaacgaggagagtatcaaaaaatgaaaacaacattagtaatcatggcagccggtatcggttcccgcttcggtggtggaatcaaacagcttgctccggtaggattaaatggagaaatcattatggattattccatccatgatgcaattgaagccggtttcaataaaatcgtatttatcattcgtaaggatatcgaggatgccttcaaagaagcaatcggtgaccgtatcgaggaaatctgcaaaaatttaaatgtagaaattgcttatgcatatcaggaattaaatgcacttccggagggagtagaacttccggcagaccgtaccaaaccttggggaaccggtcaggcggtacttgcctgcaaggatgtgctccatgagccgtttgcagttatcaatgcagatgattactatggaaaagaagcatttgtgaaattacatggcttcctggagaaatatacaccagagaaagcaaatgagttctgcatggcaggatttattttgaaaaataccttaagtgaaaatggtgcagtaaccagaggggtatgcgaggtaaacgaagaagggtatctgacaggggtagatgaaacttcaaatatcgtaaagacttctgagggcgcaggagtagataatgaggggacactcacaccaatcgatgcagaatcttatgtatccatgaatatgtggggcttaacacctgagtttatgcagacattggaagatggatttaaagagttctttgcgaatatgggagacaaaaatatcttaaaagcagaatatcttcttccgatttacatagatgaactgcttcaggcaggaaaagtatcggttaaggtgttagattctaatgataaatggtttggagtaacctacaaagaagataaagagtacgttgtaaaatcttttgcgaaactgattgaagatggcgtatatcaagaaaagctgtttgaagacctgaagtaggtggaacgattgaagaaatcctttaccagactggatgaaaattaaaagagattgatggaaaaattttgaaaatcaccacggcaggagtgtcgtggtgaaaatggaaaatgattagattaacattgattgtaaaaaagaaagcttgtacaagaaatagaaatcaattataataaaagaaaaatgagtgcagagaaagagaggtttgcttatgaattataaagagaaaaaacgttctatgtttttaggattgccatggacttttacttcgtatacgataacagatgagattataacagtggattcaggtctgcttcggaaagaagaaaatgattgctatctgtataaggtaattgatgtccgcttggaatgtactttaatggaaagaatttttggacttggaacggtccattgttttacgggtgatgtaacagacccggatttgaaattaattcatattaaacatgcaaaagaaatcaaggattatatattaagacagtcagagcaggaaaggctgaagagaaagactttaaatacgcagcatttggatggaaatccgagtctgggagagatggcagatacagatagctgtaagtaggaaaagagtaaagtgtgaaaatatgaaagtataataagttggaatcagaaaaataaaagagagccaggtgtcaggtgaaatctaagaagaaattcactccaaattcataaaagttaagttacaataaactcacaaaagcaatagagagggaaagtgaggaaaaagatatgacagtaattggtgaatttagatacgtgaatcattattttaaaatctacgaagatggagaaatttatgtggattataaacctttaggaaaagtatatgcagatggagatatctggattgcaagaaagagaatgggaaaaatctatgcagacggagaaatctggcttgcaaatgaaaaagtgggatgcctgacgccaaataaggaattgtgggtaaatggaagaagagtagcaactggagttggaagacctacaaattcaaaaagttcaggtaatacagcttctaaatcaaaaggaacgagtgaaaataaaacatatcaaactccaaaaccgcctgttacaacagaaacaggaattccagatatgtcaggagttgaaattgcagtttttttagttgctatttgtcttgcggtatcgattttgtatgcaacaactcagatatttttacatggaggactgcttggatctacttatagacagtatgccggtcagtcaaaattagttgatttattaatttatggaattccagcaggattttttgcacttgttacaggacttcagtgtgcatttaaccattcatttggtgtggttttaattgaacatgcagtttctgcatttttggaaatgtgtattttcagttgggtaacaggttatcctttactggctggtacagaatcgacaggattttatattttacttattttgatgcttttaatagcaagtttggcaccggcaacagtaagcacagtgattaagaaaattatttactggttaaaaaaataagaacggttttctatgctataattgcaaagcaattaaaattattatctggggaaggaatacaacatgggattaaaaggcttattacttggacatgaagtgaaggtttattatgaccgtcatttgacaaaaacagaaaaagcagaagatgcagagaatccaagtgaatatgaaattttaaaaggtgtggtgaacggcgtctataaggatatgattttaatttcctattcttatcgtgagaatgttcagacaaccaaaaagggactgttttcagaaaaagtgatagaggaagaaaaaacagtggaagcacattctctgattaatcgaaaatgtatcgtcagaatagatattcttgatttgaacctggaagaggaagaagaggagtacgatgaggaagaatatgacgaaggagagtatgaagaagactacaacgaaggggaagatttagaatatgacgaagcggattgcgaatgtccgctttacaaaaattaagattaacctttaagaaggacaaaaaattgcagaaaattttatgaaatggataaaacagagataaaaattgagacaatttagctgaaaaaacatccgaaaatactaattctggcatttcatgcgaaactatgatatactaaacaagacatggcgaaattcatggcgaaatgattatgaatataaactcataaaggagaatttatttatgtgcggaatagtaggatttaccggagaaaatcaggcagctccgattttacttgatggtctttcaaaactggaataccgtggctatgattcagccggaattgcagttcgtgatggagaaaaagagacagaagttattaaagcaaaaggtcgattaaaagttttggcggaaaaaaccaatggtggggcttctgtgccgggtacctgtggaatcggtcataccagatgggcgactcatggcgaaccatccgaaaacaatgcacatccgcatatcagcgatgatggaaacgtagtagcagttcataacggaattattgagaattatcaggaattaaaagataaattaacaagaaaagggtataccttttattctgcaacggacactgaagttgcagtcaaattagtggattattactataaaaaatatgaaggaactccggtggatgcgattaatcatgcgctgattcgtatccgtggttcttatgcacttgcaattatgtttcgggattatccggaagaaatctatgtggcaagaaaagacagcccgatgattctcggtgtggaaaatggggaatcttacattgcatctgatgttccggctatccttaagtacacaagaaacgtatactatattggaaatctggaaatggcccgtgtaagaaagggggaaatcaccttctataacttagacggagaagagattcagaaagagatgaaaaccatcgaatgggatgcggaagccgcagaaaaagccggttttgaacatttcatgatgaaggaaatccatgaacagccaaaagcagttttggataccttgaattctgtactgaaaaacggagcatttgatttatctgaagtcggtcttagtgatgaggatatggaaaaaatcagccagatttatattgtagcctgcggttctgcctatcatgtaggtatggttgcccagtacgtgattgaagatttggcaaagattccggttcgtgtggaactggcatctgaattccgttatcgtaaaccattgcttgataagaatgggcttgtcattgtagtcagccagtccggtgagaccgcagacagtctggcagcccttcgtgaagcaaaagaaaaaggaatccgtactcttggaattgtcaatgttgttggttcttcgattgcaagagaagcagataatgtgttctatacccttgcaggaccggaaatttctgttgcgaccacaaaggcatacagcacacagttaattgcttcttatgtactggcaattcagcttgcaaaagtaaagggacagattgatgaagaacagtatagtgcttatgttgaagaattaaaaacccttccggagaagattaagaaaattattgaagataaagaacggattcagtggtttgctgcaaagcaggcaaatgcaaaagatattttctttgtcggaagaggaattgattatgcaatctgtatggaaggcagtctgaaaatgaaagaaatcagctacattcattcagaagcctatgcagcaggagaattaaaacatggaactatttctctgattgaagatggcacattagtaatcggtgtactgacccagtctgaactgtatgaaaaaactatcagcaacatggtagaatgtaagagccgtggcgcttatctgatgggactgacaacttacggaaactacaatatcgaagataccgtaaattttgcaacttatattccaaaaacagatgaacattttgcaacttctttagcagtgattccattacagctgatgggatactatgtctctgtagcaaaaggtctggatgtcgataagccgagaaatcttgcaaagagtgtaacggtagagtaaaaatagaaaacaaatcatctggcagtgtaaaaagcactgtcagagttatcttaatcctgtttgagcaaaacacttttggcttgcttaaatatgattagattaacatttaagatgaggggacaatacgatgaaaaagaaaaaagaaaaatttagacagccaaaacaaaagaaacatcgaaatcatcacctgcgtttcctgacaaaactgattttattactgctttttgtggcagttggcatggggttttattacagttatcagttgttttttattccggttcatcaggaagtaaaaaatgaagataagggactgacaaaagaacaaaaagaagtaaaacaggaaagagaagaattagaaaaacaagagcaggaaaataagacttcgattgactatattgcagatggaagtcaggagaaagacgaatctgtcggaaaaatttcagatgaatctgacgcgctaaatgcattaaaggcactgcaaggagaacttggaattgcggatgtccaagaagaatatcggttttcagaagtgaaagaattagaagatttaaccgtttacgagatgcagcaatactatgaaggaattgaagtctatggacgaagtctgatggtaagtgtagatgaaagtggaaaccttcaaagcgtaaatggaacgtatgaacagccatctaatgtggcggtggaaccggagattcaggaatacgatgcccgagaggcagttgaagcgtatttaaaagaaaacgaagatacggacagctcagaagatccagaaagttcagaaagttcttattccctgcaaagtcaggggtatgtaatctgctttaatgaaaataatgtagccgaagcgggatacttgttctttgttgtaatgggatcgcaaaatactccggttcagcagatttttgtcagcggaaaaaccggagaaattttagcagataacagtctgattctgaccgagaaagtaagtggaacacttcagggacagaagtcttcacagacactcgattatgacaaacagggcgacgaatttaaactttgggatgaagaacgcaatattcaggtttatcgcacaacaagttccgaatttttgaatgtctatgtaaactgcgatgaaattcaatggaagacaggagaaactccggatgccggagcggttgatacgcttgcaaatctccaaaaagcgtatgattattataaagatacatttggaagagacggaattacaaatgataaaaatgttaagctggatgcaatcgttggaatacagaatgtaagggaaggaaatgaagtaactgattttagagataacgctgcaatgagtggaacagacactatgttgattggacaaaaaacagatggaagtgctacttatgcagctgaacttgatgttatgggacatgaatttaatcatggtgtggtaaacggtatatctacgcttttacagggagtttattcggataataatgcgagacagcgttcttctcagcttgcgatgggagaagggcttgcagatattttcggagaatttgtagaagattacagcgatgatgggaaatataatggctcttgcagttggacaaatcctgtcaggagcatgaacaatcgaacggatattttaaatcataatggaattttgcaggcaaaagactttcaggatggaacaaccgattgccatcagggagcaagtttaatttcctatcctacttatttgatggcaaccggagtagatggagacagcaaaaaagccatcagcgataccaaacagcttgcgagtatgtggtatactgtgatttctcagacttcaagtgcaaccggttttaaagaaatccggcaattaatggaaacccatgcgcttggacttgtatcaatgggtcatctgacgaatgatcaggtagagggggttatcgatgcctttgacgaagttgcaattgaaccgatgtatgattattgtctgaccgatgattccgaagtgattgtctatggggaaaataataagccctatgataattaccggattcaggtaaaccgaagattcggagaagaggtattaaacgaagaagtcaaaagcaagaaattaaatctgaaactggatgccggaatctataatgtggttttgacagacttaaataacgaagatttaaccaaagaatttactttgattgtaaatgatgcaaaaaaaggacagaatatttatcaaaaacaggcgaaggtcatgactcagtttggcgcaaatgttagagatgttgtgctcacactggatgtatcaggcagtatgggtggaactccgatagaagagacaaaagaagcagcgcagaaattcattgataccgtgtacgaaaaaagtccacagaccagaattagcatcattacttacagcagtgatgcgcaaaaggtagtcgattttacgaatgataaagcgaaattaaaaaatgcggtttccggaatttacagtggtggcggaaccaatatagaagcgggtcttaaaaaagcgtataagctaataaaagacgaagaatctttgaagaaaattgttgtcttgatgagtgatggagagccgacagaaggaaaacagaaagacggaagttatcgggaaccgattctcagtatggccaacaaaatgaaacaggataacctcatggtgtatacacttggatttttccataatttagagggagaaaatctgggagaatgcagacagttgatggcagatattgcgtcggaaggttatcattatgaagtcagcagtgctgattcgattcagtttgtctttgatgatattgcacaacaggttggcggtggagaatatgtttatattaagattgagtgtccggttgatgtaacagtgcaaaaaaatggtgaagtgttacggtcagaaaaagaaaatcaaaatatccgaacaggctttggaacattgtcctttgatggagaaaaagatgagattaagattctgagattgaaaaaagaccagaactatgaaatctgtatcaatggaaccggagaaggcgaaatggactacagtattggatttgtcgatgaagatggcacgtattcggatatgcgaaattttgaaaagattccggttacaaaagaaatgctggcagtaaccgataccaaagaaggcaaaaagacgactcttcaagtcgatgaaaacggcgatggacgttttgaaaaagtttacagtgcaaagaaaaactcgacagcagtagaagtttcaaaagaaaatcagaaaaaagtgctggtagcaataggaattgttgtacttttatggatgattttaaaagctcgtgcggtactgaaacgggcaaaatcaaatcgatactgtaaatactgtggtaataaaatcacaaaagaaatgaaattctgcggagaatgtggtagtccggttgagatacagccgttattctttgaaaaacatgcaaaagaatcaaaaggaaaacgaaaagtaaagcttgcattaataggacttttactgttattctgtgtatcggaaacgatgatttatcagacggcttcaacgaaagtttatcgctatgtgtgccggggaaattatacactggcagagaaaatgtatgatggaaatgtaaaaggtcataagatttcccaaaactatctgaacaatctgcttacctatcatgaaaaacgtgtaaaaacagcgtatcaggcaggtacagtaaatgaaacttatcttacagaaattcaggagattgtaaagaaattaaagtagaaaaaatttaaattaaaagacttaaattaaaagatttaaattaaaagacttgaattaaaaggcttaaataaaaaaagacggaaaaaaggagacgaaaatgtacgattatctggtagtaggttcaggtttatacggagcaatttttgctcatgaagcaaaggcatcaggaaaatccgtgcttgtggtggaaaaacgcccgaatattgcagggaatgtttatacagaaaaaagggaagggattcaggttcaccggtatggtgcacatattttccatactaataataaaaaagtctgggactacataaccggatttgctgaatttaaccgttttacgaacagtccggtggcaaattataagggagaattgtattctcttccatttaatatgtatacctttaataagatgtggggagtggtaaccccggaagaagcgcaggcaaaaattgaagaacagcgaaaagaaatcattggagaaccaaaaaatctcgaagaacaggcgatttctttagtcggacgtgacatctatgaaaaattgattaaaggctatactgaaaaacaatggggacgagactgcaaagacctgccggcatttattattaagcgtctgccggtgcgcctgacttttgataataattattttaatgcactctatcagggaatcccaatgggaggatacacaaaaatggtagaaaatttactagagggcattgaagtacgcttaaatacagattatcttgaaaacaaaaaagaactggatgcgcttgccaaaaaagtggtttataccggtccgattgatgcctattttgattatgaactgggatatctggaataccgcagtgtacgctttgaaacggaaacgctggataaaccgaattttcagggaaatgcggcagtaaattacaccgataaagagacaccatggacccgtattatcgagcataaatggtttgaatttggaaaagatgaaaatggggaagagcttccgaaaaccattatcagccgagaatattcttctgaatggaaaccgggagaggaaccttactatccggtaaataatgaaaaaaatgtagcactctatgccagatataaagagatggcagaaaaagaaaataaggtaatttttggcggacgactcggagaatataaatattatgatatggaccaggtgattctggcggcgcttgaacggtgtgaaaaagaatttaaccaaatcaagtaagtcccctgcttcaattgcaaaaagcaataagcagcggattgcgaagatccgcctaaggaatagaggaaaaataatgggaagaccaagaaaaaatccggagtacaatccggaagaacagtttcaaaaaatgctggaggacgtaaaaggtgcttatgagaatgcagattccctgcgttctctggcatcagaattaaatatgacattgttaaagcttcggaaattactgattacagcaggcatttttacttcggatatctgtatggaggtgaatcaactgcatgaacagggaaagacgattccggagattatgaaaattacaggactctcaagagcttctgttcattcttatctgccttatgtcaggggaatttataatacagaagaattaagtctggatgcaaagcgctgtcggatgtatcgcgaacggatggaacgtgtaagaaatctgcagttaaatccaattccaaaaagattatgggaaacgttagtgatctttgaagattatccatttcgaagagagacaaatgagttgttccgctatcaggtatctgaagcaggtaaaaatccgaagaaactgtttttcaaaaacggagagcatgagtgggtgctggaatggagagaaatccgtaaaagcttaaaagaaggaacagaaaacctttatattaaggcaattttcagcagatttggtttggaagatatggattagaagatatgaataaatagaatgtgctttaccgtaaaaacgatttatctaatattttttttaattgttcagattttattgttttttaaaaagcagtgtgctatcatgattaattgatatagaattagtatgtagaacaggatgaattatgcccttggtgcaatagtaaccattaccgtaaatagaacagatggtacgaaattacagatgataatggtgtgggagatatttcagcggctgactatcggtcaaaattacactatttaaagtagtaacaaaagaataagcagaggggatgagtaaataggagatatttatttattcccttttttgattttatgaaggaatttgagagttagagattttttcctggagttaaaaagagaaacggaaagataaaaggaggtgacagcccatgtccatggagactctgaatgttatccagtttatagaacttttaataggatttcttggatttacagttggattacctgctcttgttttttataaaaaagtgaagcattttcaggcgtcggttcgttttttgatttattttgttataggaaatttttatattatcaatttagttcaggtgttggaactcgtatatgtttcgtatcgaattacattaatattgtttacaatacttccggttataattgcagttataaaaatttacaaaattccagtctggtcttatataaagaaaataggaagcgagctttatcattatattttgcgggaattaggctttcgtagttttttaagacacagactgaaagaagtgtgtaaagctttcaaatttttgcttcgtcaggcggtgcgtttattaaaagagctatggctggaccttccgtttttatgtattttgatttatcttatctggaaaatctgtggagacggaattttaaataactgggggtatggtgcttctgatgttccggtgcataactactggattaatggattagttgaaaataaattatatattgccggaatttacccaatggggatgcactgtatgttgtattatctggcaactgttttaaatattcctgtttatgtgacgctgcgtttgttctggctggttcagtacagcatgattgtatttatgttgttattgtttttaaaaggatgctgtaaaacaaaatttctcccgtatttgggagcgattggctttgtgggattaaaatatttcatggaaatttcttactcccgatttgaggcaacacttccacaggaatttggaatgctgtatattcttcctgcgatttatttcttgctggaatattttaaaaccagaaaagcggaattagagaatggagaaaataaaatccgatgctgttcctcctggaatctgcttggtttttcaatgagtttttctctgacgttatcgtcgcacttttatgactccattattgtcggaattatctgcgtgggaattgcaattggatatagtgcgtggatttggagaagaggatatttgttccgaattatagtttccggagtgattggagtgttaatggcactgcttccgatggcagttgcgtttttgacagggaaagaacttcagggttcaatgtactgggcgatgagtattatagggttgaaagactataccgttctagtatttagaatcatttgttttgctgtagttgcaacaacaattgtgagtatcgtttttttaattaggggaattaaaaaaaagacaatttcttttacggaaaacagaccaatccatacagaggcaaaagtgcttttaattatttttaaattatttggagtattgcttttagcagttctgttgtttcttggatggagagaaaaagaaattgttttttggggactcagccagtatgtatttgatttaaccgattttaattggatgctatatgcggttggaattgcagtgatagttggaattacagtgctagttggaattgtacagagttattttatgaaaaatatggaaggtgctgctctcttatctctgttatcagcagaagtgatgctgggaataattctggtaagtgataagttaggtttgccggttttaatggaaaattatagagtttgtgtctatttttcttatttaattccagctgtatttattttggcattggacaatttgataggaattttgtgttttaaccgttttataaaaattcaaaaagtaatagcatttggtatggtgattattttattaggatatagtacaaaagagggatggatgaaaaagtcttttggtggtggagatttggaaatgaatgaagcgattctttgtaccacgaatattttaaaagataataaagggaaaaatgatacttggaccattgtttcagaaaatgatgaattgcaaatgatagaactttatggacgtcataaggaaaccattacttttttggaacagatggaacactggaatcagacaaaggaaattctgatacctacagaaagggtttatttttatatagagaaaaaaccattaaattatgcagatgagtatgaaggaaaaattccggaaatctcagaaaaacaggctcagaaagcacttccagaaagtacaggaatgaatgcttataggggtaaaaatcgttccgttacgatgtcgagaatgtactactgggcacaggaatttcagaaactctatccaaatgaattcaaggtttattttgaggatgaaaattttgtctgttactatatagaacagaatgtctatcgcctgtataattttgcaattgattatagatataattaaaaaattcacagataaaggggtaaaaataaaaaaacaaaagaaaatggagtaaagaatggatattatgcttgttggtggagcttcaccactgatgaaaaaactttctttaaaattacataaagagggacatcggatttttgttttatcgggaagccgagacccgcagaatcattatgaacatgtatttgagcgttatgatttttcttatgacaaagcatccgtagaagaggtgtttcgcagtgtaaatccagatgtgacaattttgatgggagcttatgactcaaattatccaggaagggattttagaagagaagctgtagcgtattcggcaggacttcagaatcttttgctttcgtggtctgccttaaaaaaaggcagattgatttatctttcttccgtagaagtttatggagggaaatatccaagtgccgtttccgaacaggataagccaagaccgagaggcgttcgaccgcgtatgctctatcagggagaagaaagctgtcgtttttatcaggaagaactgtcaatggatgttgtaattttgcgactggactggctgcatgacgtttgctgtagtacgaaagaggcattaagcagtatctgtggaagaaaatgtctggatgcgtttcgagatggttctgtttcttatcaaagaaattatgcctatgcgctgacttatataggagatgcagtagagagtatttataaagttgtggcatgtgaagaacatcaggaagcgctgtatcatatttcttcatcggaggcatactcagaacatgatattgtaaaaaaagtcggggaagtgcttggaaagaagatagaacagattgataatatcgtgggagagcagcatcagattattttatccaatgaacgttttaaggctgagtttggatttaaggtctggtgcagaccggaagagacaatagaaaaaacgcttcagtatatgaaacagcacagtaataaattcttagatgcagaccatcccggaatggatatctggcataaattgtattatgccatgacaagtacactgggagcattggttccgtatcttgaaaatctaatcttatttattccgttttttatgttaaataatcgtgcaacggacagtcagtatttttcgaagattgatttttatttgttatatgtattgttatttgcggttatatacggacagcgtcaggcaaccttttccggaattttggcaactgcaggttatctgtttcggcagatgtatacccgctccggacttgcggttgtaacggattataatacttatgtatggattgcggaaatttttattgtcggtttagtcgttggatatatgaaagacagcctgctgtttttaaaagaagaaaaagaatgggaagttggttttttatcggaacaggttacggatatcggtgacattaatgacagtaatctcagggtaaaagagggattaattgaccaggtgattaattatgataacagtctgggtacggtatatgatgcaacagaacagctggaacagaaacagtcggttgaaattttcttttgtgcgttaaatatgattcagaagctgatggattgtccggatgttgcaatttatcgtgttaacaaagaaaagtatgcgaggctctttgcttatagttctgcaaaagcagcttctatgggaaataccgtctatttgccggataagaaatctctggacgaggcatgtaatgagaacagggtttacattaaccgttccatggaaaaggagtatccaatgatggcatataatgtggaatcagaagaacagatggagattctgattatgttatggagtcttccttttgaacgaatgaccatcaatgaagcaaacaggctgattgtaatcggaaagctgattcaaacttctgtcagaagagcggaccgttatctggaagcgttgtcagaagaacgttatcatagcgaaagtcagatcttgaaagcttcagcttttgaggaattagtaggagcatatcgaaaggcaagtaaagaaaaactgacagaatatgtactgcttcagattgaagtggagggcgaaaatgaaaaagaaactgtggataaatttacttcgatgcttcgagaatctgattatattggaaatctttcggatggaaagttgtacttgttattaacaaataccgatttgaaaggctgtagttttgtacaaaataagttaaaacaaaacggagttgcctccagcatcagcgaggagggaagactatgatgcactccgggtattggtttcttattttgttgattttaaatacgttaactgcattgctttatttaatctggtatctggtttttaaacaggataaagataaccgaattcagtatatcatgcatacaatcgtgatgatactttgtcctttagtgggtccgttgtattttctgcttggatttttaaagtatcattttatgaaattgggagaaagagatttatcagatgtagagtttgcaaaaaaaagacatgtttcccgtgtaaaagcagatgaggaaagagagcgaaatattgtgccgattgaagaggctatttccatttcagatcaggagaaaaaacgagaaaatatgttgaatgttttattaggggaaacagataattctctggcctctatttcagttgctttagacagtgatgactctgaggtggcgcattatgcggcatctttcctgcaaagtaaaatggatgaattcagagagcatgtaagacaggcaaaattaagtatttcatcaaaggatataaaagacgaggaatgtcaggaagaaataaaaattttgattggatacatgaatcatacgctgaagcagaatattttgacgagcatagaacaggaagattatgtgcatcagatggaagcattatgtgaacagctctatgaaaatgcaagggaaaagttagaagtaactgattatagttttctgcttcaaagattaattgaacagaaattttatgaagaagctgagaagtgggcagaacggtttatgacacagtatccggatgaattgaaaccgtatacgctgtgtatgaaattatattttgaaatggaacaaaaagaaaaattctttgaagtattggacaaattacgggcttcttcgattgtcattgacaatcagacactggaattaattcgtatcgtacaaaggtaaagaaaaaggaggaaaagaaatgctttcaaaacgaaattttggaatgatgatgacgattatcctggtaatattaatccttttcctctcatcggcggtattaagagagtattttaatgattataatgagaatcattcggcagattctgaatgggtaaaacggtcagaagaaaccaaagaaaccaaggacagcaaaaacagcgaaaaaaactggcatatcatttatatcggaaaacaggatacaggatattatgagtccattcaggagtggtgtacgtatcgaaaagcagaatttgaagaatattctgaaacaaaaaaagcattaaaaaaagcagaggcttatgaaaaaaaaaatacgtatcttttaattagtggcagtgttctcgagaaagatacagaaacagtttccgatagtttgacttcttatgtggaagcaggtggaaaaataattttttgttctcttccggattatttggtgattgcaaaatcagaaacgttaaaaaatcttttagggattcagcagttaagagcaaaaacggtaacgctccaggaaatctggctgtatggtggatttttgcttggcggagaaacctgttattcctttgatgaacttcaagatccagacagaattgatatggaacgagagattccatggtatgatatttcttcccggaccaaaacatatatggtgggctttatcaaagcagaagagcagacaaagcaggagcttcataatgaagacatgccggcaattatctggcggtgtaacacaggagaaggttcgatttttgcagtaaatggcgattatatggagggaaaatcgacattgggaatattagatgccatggtttatgaatcacagaattatgcactttataatgtggtcaatgcgcaaaatctttcgcttaccggctttccggatttaaccaaagaaaatgaaaaaaaatttacagaagtatatggatttgattcaaaacagttttgtcagaacattgtctggcctgctttgatatctgtagctcaagatggagattggaagataaccgcttatctggcaactaaacaggataatgattccaaagaagatgcggatgtaaaatccctggttgattatttgaaatattttaatgaagaatcggcagaagcgggaatatcgcttggaaggatgaatgatacagatattcaaaaatcactggaagcagataaacaggaaatagaaaaacaggatattacgtatccattttcgggggcttacattcgaagtgaaaatgaagaacagttatcaaagttggtaaaagatgaaaaattaaaaatattttcagatgttcgtacgatttgtaaagcgtacgatgaagaacagccggttttttcctggatgacagactggattacaacacaggcaattacaatgaatgggtatcaatatacgtataaagatgactttcgtttaaaaagcattcagaccgcattaggttattctaatgtacaggcagatatatatcgtgcgatttggcctcaaaagagaaaagatgagtgggaagtaatttctgaaaaattagcctctaatattagcacgtactggaacccattttctgtatttgaaaagacaacaattacagagagtgacaccagagtccgcagatttttaaatgaaagtgtgacaagcgataggaaagcagaccaaatttctataaaagtagagaattttaatgaggatgcctggatgatgctgcggacacatggagaaaaaatagaatccatgaagaatggaagctgggaaaaaatagaagatgatgcctatttactgcatcttacttcaagtcaggcaacggtaacactgaaatcggatacagaactttattacagtaaaaaataaaggagataaacaatgcgaatctgttttattgcagaaggatgttacccttatgtggtaggcggggtatcaagctgggtacacagtatgataaaaaattttccaaatcaggaatttatcctgctcacgattgtagcaaatcgggaggcaagtggaaagtttgcttatgaactgccggagaatgtaacggaggtttatgaggtttatttggaagatgtggattggggaagtgtcaataaacataataaaacaagattaagtgaaaaggaatatcatgcacttagaagtctgattttgaatcatgaagtagaatgggacaatatttttgaattttttcataaaaagaatatttccttgaatcagcttctcatgggagaagacttttatcatgcagtgttagatgcgtacaatcttcagtatccggagattgtattttcagattttttatggacgatgcgttcgatgtatcttccgttattcttttgcctgatggcagaaatccccaaagcggatgtgtatcatgcggtggcaaccggatatgcaggggttcttggaagtatgggaaaatattttcattcaggtcagcttattatttcagaacatggaatctataccagagaacgagaagaagaactgataaaagcagaatgggtacagaaagtttataaaaaaatctggattcagcagtttcgcaagatgtcaaaagtttcctatgagagagcagatattgtgacaagtctttatcagcatgcacaggaattacagattgaacttggttgtccaaaggaaaaaacaattgtgacaccaaatggaattaattatgagcggtttaaagaattaccacagtgtccgccggagcaaaaagagtatattcatattggagcggtacttcgagtgactccgattaaagatgtaaaaacgatgattcaggcatttggatatgcaaaaaagagagagccaaaactaaaactatggattatgggaccatataatgaagacccggattatgcggcagagtgttttcggatggtagagacaatgaagatacaggacgtagagtttacgggaaggatacaggttacagattacttaggctggatggatgttactattcttaccagtatcagtgaaggacagccgcttacgatattagaaagttatgcagcccatgttccggtgattgccacagacgtcggaaactgcaggggattaattgagggagaagaggatgattttggaagggcaggaatcattacccatatcatgaatgtaggagaaattgcggaagccatggtgtatatggcaagaaatccggaagaaagaaaggcaatgggagaagctggttataaacggctgatgaaacgatataaaatcgaagatatgaaacaaaaatatgaagaaatttataaagagtgtgccgaacgccggaacttagaatgggaagaataacttttaagatttgagagtacatacagaaaaaaggagaaaacaatggcaggaataggagtaaagttaaaccgtatttatcaaaaaaatacgattacaacaaatattgtgggatttttctatagtatgactatgacaattgcaccggtattagttgtaattattaacctgatgctgatgcaaaaagtgttaaaatttaatactgttcgttatattgatcgtgaattgttttcctgtacggtgctttatgtttttattttctctctgcttacaacttcgccatttaatgcggtattatccagatatatgtcagatgcaatctttgaagaacggtatgaagatgtgcttccatgccatcgaatcggtctgttgatcaatatctgttttagctgtctgtttgcaattccgttttgtttgtgggaacatttcgttggaaaagtgccggtgtattatgtgtttacaggatattgctgttttgtttctctggtgcttgtcttttataatatgttatatttgtctatttgtaaggagtatcgattgatttctttgcattttgcacttggaatgattgtttcttttttgttatctttattctttcgatatatctgtaaaatgagtattccttatagtatgcttttgtcacttgcaattggattttttgtgaccgcagtgtttgaatgggcaaaagttcatcagttttttccggataacagtgaagaatacaggcgggtattcgtctattttaagcggtactggcatttgattttaatcaattttttatataccctgggattgtttattcataattttgtgttttggggaaccgatatggcaatgcatctggtaaaaacatttgtatgtaatcagccttatgatatggcaacctgccttgcaatgtttacgaatttatcggcgagcgttatctttatatcaagggtagagatgtatttccatgagcgttataaagcgtatgctgacgcagtgttcggagggcgtggtcttgatattcaaaatacaagaaagcgaatgtttcgccagcttggcagtgaactgatgaccttgattcgactgcagtttattatttcagttgttatttatctgatttttgtaatctttcttccgagaatgggatatgcaggattggttatgcgaatttatccgatggtagcagcaggatatttcattttatttttaatgtattcagaaatcattttcttatattattttgaagatttacagggcgcattggttacggcacttagtttttgcggagtaacgtttcttgcaagtttaattgcggttcatcttccggcagttttttttggagttggaatctggacaggttcagtagtaggatttaccgttgcttatatgagactgcgttggatggaaacacatattgacgagcatatgttttgcaggggaaatctgataaaaagaggaaaaggaattaaaccatctgcaaaagtgtttgatatacgagaattaaaaaaagagccggaggatgaagaatgagatgaaaaaaatattatttgtgattaacacgatgggctatggaggtgcagagagggcattattaaacctgatgtctgcacttgaaaaagaacagtatgagatttctgtatttgtacttacaggtcagggagaactgattcatcagataccggattcggtgacactcttaaacaaaaattataaagatgtctctgttttgacctcgaaaggtcgtatggaattaatgaaaacgattttaagagctggaatcttaaaaggagcattttttcgcaggttttcttatctgataaaaaatagtgtaaacatgaaacagcaggggcgttttttaccagataaacttttgtggagaatattagcggacggagcaccgatgatgcccaaagaatatgatttagcagttgcatatttagaaggcggagcgacgtactatgtggcagacagagtgaaagcaaagaagaaagcagcgtttatacatattgattataagaaagccggatatggcgaaaaactggatttgggctgttatgaaaagatagaccgtatttttacggtatcagatgaagtgaaagaacattttttaggggtttatcccaaatatcaaaataaggtgtcagtttttcataatctgttagatatggataatgtaagaacaatggcagaaaagccaggaggatttcaggataattttaaggggattcgacttttgacagtaggaaggcttgtagcacagaaaagatacgatatggtgattcaaacaatgaaacttttgaaacaagagagtaagaaacccattcgatggtatatcatgggagagggagaacttcgtacaaaattggaacagcagatttcagagaatcagttaacggaggatgtgattcttttaggagtaaaagaaaatccgtttccttattataagcagtgtgatatttatgttcatgcaaccggatacgagggcaaaagtattgcgattcaggaagcacagattctaaaaaagccgattctggcaacggactgcagcggaaatcgggaacagattgagcagggaatagatggaagattatgtacacttacaccagaaagtattggtgatgaaattctatggatgatagaacatccaaaggaatgtcaaagttatggagaaaaggcagagaaaaaagtattacagagtaataaaggattggatgaatttttaaattggatgaagtagttttggttatttacgaatgagggaaaaagatgaggacattagtgttaataccagcatacaatgaggaaaaaaatttagaacgagtgatagaaaatttaaagaaaaaagctccacagtttgattatatcattataaatgatgggtcgacagaccatacagaagaattatgcagaaaaaaacagtatcattatatcagtcttcctgtaaatttaggattgaccggagcaatgcagacagggatgaagtatgcaaaagaaaagaactatgatatggcaattcagtttgatgcggatggacagcatttgccggaatacatacaaaaaatggtggactgcatggagaaaacaaactgcgatgttgtgattgcatcgaggttctatggaggaaaaatgccgcttcgaatgagaacagccggtgcaagattgattacagctgctattcgcctgacaacaaaaaaatatatttccgacccgacaagcggaatgaggctgtataatagaaccataatagaacagtttgtaaaagatgcaaataattctccggaaccggatacactttcttacttaatcaggcttggcgcagatgtcagagaagtgagagtaaaaatggcagaacgaacagaaggaaaaagttatttaacaccggttaatgcatcgaaatatatgatgcagatgctgatgtcaatttgcatctttcagtggtttcgggatagaaaggcggtattataagatgggaattttaagctggaagtttcgaattgtattgtttttgggaagcgttgttgtgtttttattgattgcccgtttcgtaagaaaacagagaattcaagtgaaagatggaattttttggattttatttagtgttatattaattatattttcaatttttccaaggcttgcgatatgggcttcttatttaaccggagtacagtcaccggcaaactgtgtttttatgcttattatttttacattaggatgtcaccagttctttttatcaattaaagtttctcagcttaccatcaaaaacagtgagctgatacaggacattgcaatttatcggacattagaaggtgaggagaagagagcaaatggagaggaaaattcataaaaaaaagatttgctttttttcaggagacattacaagaagtggtggaacggaaagggtatcggtacagcttgcaaatgaactggcgaaagaaaaagaatatgaaatctgttttttaagcctggtagaacaggcagacaagcctttttatgaaataacgaatgatataaaaagatattctcttggaacacactggattaatccgggacctggatatctgcctttgattggaaagttaaaaagatttttaaaagcacaggaaatagatattataatagatattgatattgtgttggatgtactgtcgattcctgctgcaaaaagattgaagacaaaagtgatttcatgggaacattttaactgcgaatttgaacagagtgtgctgtatcgaaaatggatttcaagattgtcggcaaagaaagcagattatattgtaacgcttacagagcaggataaacagagttatggaaaacttctaaaaagaacttcagatattgaaactgtctataatcctttttctcaggtggaattaaatgaaaatataagacgggaaaactggattgtgacagtaggaagattaacctatcaaaaaggaacagattatttggcagaagtagcaaaagaggtattaaaacaaaataaagactggaaatggattgttttgggagatggggaagaaagaaaaaaacttgaaaccataactaaagagaatgatttagaaaaacaattgtttttaaaaggtagagtagaaaatgtagaatggtatttaaatcgtgcaaaattatttgttttgacatcaagatatgaaggacttccattatgtttgattgaagcaatgcagatgaatgttccttgtgtgagttttgatgttaaaacaggaccttcggatattatagaaaacaatgtaaatggaattttgatttcaagttttgaaattgaaaaaatgataaaagaaattaatgctcttttaaaagataaatgtagacttcaaagtatgtctaagaatacaagagataattttgaacgttttaaaatggaaaatattattaaaaaatggaaaaatatatttgaaagattagaaaaatagaggaaaagaaaatggcacaggtaagtattattgtaccggtatatcaggtagaaaaatatatccgaaaatgtattgaaagtatacaggcacagacattttctgattttgaattgattttagtggatgatggctcaaaggatgcatctggaaaaatttgtgatgaatacgccaagaaagatgataggataaaagtaattcataagaagaatgaaggagtagctctggcaagaaatgatgggattaaactttcaaaaggaaaatatgtctgttttatagatggagatgattggattgaaaagtttatgattgaaaactgcatgaatagaatcttagatacagaagcagatgtgatttttcatggttataaacaagaactatggaaaaataaagttgtaataaatatagaagaaaaaagtacttcggattttttggatactttaacgcatagtgaaatgtctgaaaaaatggaaatgctttggccatattgtagtagctatgtatggaattatttttttaccagaaaaataattaaagaggagcgttttccaaatgtaaagatttcagaggaccatatatttatattaaatgtattaaaaaaatgtgataaaatttcttttttaaatgatttttcttatcattactgtatgagaatgggttcttctgcaaatagatggaatgatacaggattgttttgtcaaataaagatgatagaaacttgtcatgagtttatggaatcctttagtatttctgaacaaaggaaaaaaaagttgatggcgcagataactttaagcgcttattcttatgcaatttatacattttgttttccagaatgtaaaatttcagtaaaagagaaaatgagacaattaaaaaaaatgaagaagcagttaaatctaaatgaatttattccttatgtagaaatgaaaggtttgtcgttttctgaaaaaataaaaaccaagatgatttgtaacaaaatggaaatattattagttttagcaggtccgatatttatgaaagtagtgcgcagggcataaagttaataataatagaacagaaatataggattattgaaattgaaggagattattcaaatgaagaaaatttgtgttattatgggcggagttctgccagttcggattaaatgcaatttctgtgcgtgaaaaaagttcaattcctattttacaagaaatgaccaataagccaatacaggtagtagtagaccctgtactgttattacaaaaaaaagaatgggagcaagttgcacgagttccgcaaataaaacaactatacttagtatgctatttattggaagataatatagcacaaagaaaagcagtggaaaaattagcaaagcgattaaagttaaaaatattaacatttccacacattttgtgtaatgtagttcgaaaatgcgatttgttttttggtgacattcatgattatacttccggtcctcgtgagtttatcgggttaattcaaaatgccgagcttatagttacagattcttttcatgcatcagttttttcgatgatatttgaaacactgttttatgtttttaaacgagataaggcagatgcaaaaaacagtaccaatcgacgaatttatgatttcttaaaagagtatcagttagtatcagaagagagtttggcagaggtaaataagattccagaagttgattttaaatatgctcatcagcattgggaaaaaagacgagaagaatctttggaatatctggaacatgcattaggagttaagaggagaaaacacaggtgaaaaatcaattaaaggcgggagttattttttcttatatatcaacaggaattacagtactcatacaattaatttacttaccgattatgattcggatattaggacaaagtgaatatggtctttattccgtggtatcaggggtagttagttatctgagtttgttcagtcttggattttcaggggcatatttaaggtttttttcaagatttaaataccaggatgataaaaagaagcttgcttctttaaatggaatgtttattatacttttttgtgttttggcattcattgcacttgtttctggaattattcttagcttttttcctcgtcagatttttggctctaaattatcagatgctgagctgataaaagcaagaatattgatggcgatattggtttttagcatggcaatagtacttgttagtagtatttttgaagcaatcacaagagcatatgagcaatatatatttcagcaggctgtttatttaatggtagtagtagttaatccgtttttatgtttgcctttacttttaatgggatatagaagtgttatgcttgtgcttgttggagcagtgattagtatagggcggctggttgctaatgtttggttttgtgtgtttaaactgaagattccgatctcttttcacaactttgaatttaaattgctaaaggaaattagtgcatttagcttttttttattgttaaacatgttgattgaacaagttaattggaatgtggataaattaattttaagtcatacaagcggaacaaaagaagttgcggtttacggtgtggcatcacagattaatgggttatttattaacttttccacgactgtttcatctgtgttttcgcctaaaattaatcggattgtggcagaagagagagaaaattatcaaaagaaatttacaaaattaatggttaagataggcagaattcaatggttgttattgggaatgcttacaacaggatttattatatttggaaaatattttattgtacatatttatgccggtaaaggatatgagaaatcctatatcacttcattatgtctggtgataccggcactcatacaattaattcaaaatgttggagttgaaatgcaacgagcgttaaataaacatcagttttgctcaattatttattttgtaatggcaatcataaatgtagctattagtattccgttggcaaataaatttggagctgtcggtgcagcgatgggaacaatgattagtttagtaatatcagatgggataattatgaatgtattctatcataaaattctgaaaatcaatattaaattattttggaaagagattatgagtacattaaaaggatttgcagttccagtgatatcaggaatactgattatgaaatacataaaatttagcagtattatggaatatttagtagttggtggagtatatgtagttgtttacagtatatctatttggaagatgagttgtaatgaagaagaaagaaaaatggttttaggattaataaataaattttaaatgcagatttacgatgctgaaattgaaaggaagattgatgaaagaagaaaatggaagaatggattaatactccattcttcccagcaacagtccttcttcttgtatgccctgcgtatttgcaagtgaaatttgtttttcactttgtgcatccgtaatagaaagaaaaacctgataagaaccggacttaagactttttcgtggtagagagaccgaaagagtctttttttgtgtactttttagtttacgaaggtcgtagtcaattggaacagaagagatttctcctgtttctgtatttttaaacttcagtgtagcatgaaattcttttaaggtgtttccaaatccggtattttgaagtccaatggagagatttagctgagagtttaaaaatccggaagatttcattgtgcattttgtaaccagataccggtagccaaggtgtgcctgaatataggtatagccatcacatccataaaaggcatcgttttgattccaggttgtatttttccacttatcgagtacggtgttgtcatagtctgcatttaaataggaaacatgcatggtggttaaagactcaactgcagaaggtaaatcattataagagttgtcggaaaccacttctccgccatttggaacatactggcataacgtgttttgaaattttaattcgtcttctcttgtacctttataggacggagaagtggcatcttttctttttgtatcgccataagtgccaaggtcagacacagatcctaacattccatcattgtaaagccccaatcttgctataagattcccatttgcctgaaaagccggaaattttttcggaacatcgtataaatttgtaatcatacgccagtgggcaggagtccggacagataaataaatcgaagaatcaatggattcatttaagtgattgattagggtatgaacggaagtatcattcataaattcagacccatgcatttcaccccagtttccgataaagattccctgcatcagataaacagaatcagagtaccggtttacgatttcactgacttggtctatgtgggtaaggatggtagaaagtgagtctggttctgtcgcctttgcgataccatccaagtcatagagaaaacgaagaagaatctgagtgtcggtattggaccagtctttgaaaatctgttctaattgtgaaagggcatgttcactgatatcggtatttttataattttttaaattgatttctagaagaaccaaagaatcggaatacgtgtcagcgtgtgaggcaatcgcttcatctgtgtcatttaaagtatacccgatgatgtgataataaccttgataaggattttctaagacttcgttactttcagaaaatttttcagcggtaaaagtgacggattggcgcatacatcgaagaatcagaacaagaatcaaaagcccgaataagaaaatgagaaatctttggattaaattcattttttctatttcctccaattttttcgtgtttttgatattctatcaatttatgggaaaaacgtccagataaacttagaaaaaaatctttggatttttagcatactgatgtataataaatgaaaatacgaaagaaaaaatgaagaaaatggaagaaaaacttaagaaaatagtggaagaacaaaatttagaacaggaaaatccagaggaacttgccctgcttttatggcaggttttaaagcagtatgaacaggtagaatttcagacggtgaaaggacttgcgtttacttatgtaataaaaggcaacgaaatgtttattgacaggaaggaaaagtcgattacgaagtcttcggtcttacttgcgtttcaaaatttggttaagcaaggaggcatcatcagtggtccgaaaaagcttggaacatttggggcgagttatttatatccgatttttatggaattaggatggattgtggagtgacaggttttgtctatacagggagaaaaagaaaagattttattgaataatcgagaatagacgagaagaaaggttgcaaaattggaaacttatctgtataatgtggtattggctataaaaatgaaaacagaaaagtagaaaaagcacgaatacaataaagaaatagcaggagatttacaatgacaacattaaaaacaagcttattatcctacaagaaaacagaactggaatcttatgcaaagacattaggaattaaaagaatttcttctttaaaaaaagcagaaattgcagaaaaagtagcagacgaattattaaatccggaagtaatggcgaaacgtctggcaattcttgatgatgcgcagattgcattgtttgaaaaagcagcaaagggtgcttttatggcaacagaagcagagatggatacagcttatgaagcctgtgcactcgactacatgcaggtatctgaagagggaatgcttgaggttacagaagatgtagcggaagcttatgaaaaaatggaccaagagacatttgagaaaaagagaaaagaagtatcctggttagcgaaatgtctttctttttcagcagccatgtatggggtagcaccggttgatacggtccgcacagtctatgaaagccgtccacattatcatgcagataaagaaacgtttatggcattatttgatgaaatcccttatgagatcaatccatgtgttatttctgaagatgtcattatggacagaaaattaatcgcaggagatgcctatgaagcattattaaatgaacagcagggaaaaaaattctatgttccatcctggcagcaggtggaagaacttgctacaaagggatgtctgttagatgaagcttcttataagaaattgtttgcatttttccagaaagaattggagcttggatatgaggaggcagtagccgtaacagcagatatctggaatcatttgtcaacaggacatggtgatgtttacggaaaacttcaggaagtaattgaaaaatatcatttccagagtaaggaaggtgtaagaacattctctacactgcttcagggagtggtaaacagtaccagaatgattatttacagaggtcatactccaaatgaaatcacagtaaagagaccaaaaaataatttcccgaatttccacaccgcacagccaaagaaaaatcagaagatttatccgaatgatgtatgcccttgcggaagtggtaaaaaatacaaaaaatgctgtggtaaaaattaagaaataaatttaagaaacgaagcaacaaaaggaatgcccgattacaaagaaagagtgaggcaatatgaagaaaaaaggcttatttattttacttggattgatttgtatcgctgttgttggtggttcaggtgcattatttataacacgcgataagacaggtcctaaaattatagtttcagaggaccggaagatagcctacagtacagatagtgataaaacagtattgcttgacggtgtgacggcaatcgatgaaaaagatggagatgtttcggattcactgagagtcgagtctgtgcgaaacaatgaagatggttcattagaggtgacgtattcggcagtggatgattccaataatgtaacaaaacttacctgtaaggtggaaactctgaatcaggaaaattcagatgaagatgcgaaagaagaaaatacggaagcttctgaagagaatcaggaagaaaatcaagagaatacacagcaggatgaggaagataaagaggcacaaagtcaagaagaagcaaatcaggaagaagttgatgatagcgattctgatacagatgcagcaatcgcagcacttccggagggaagtccacagcttcgtctgtcgacacatcaggtagatttgcaggtgggtgcatcttttcaatatatggactacatagaaagtatttcagatgataaagatgaaacaaatgagttatatcgtaaaatttatctgactggtgaggtaaatacaagtcaggcagggaattatgagatttcttattatgttacagatagtgataagaatcagtctaatatagaaaaattaactgtaacggttcatgaataacgaaatggattctcgaagaattcactgtatttgcataatgagagttcgggaatgtctagaaagagcaggaggatgagaatgttatttgatatacattgtcatattttaccggcaattgacgatggctcaaaatcaatgaaagaaacagaaaaaatgtttcggatggccagaaaagaaagaataggaacgattcttgcaacgcctcattatagctgtgaaagagaacctgaattttataaaagatgtcagaatgtatacgaagaagtttgtcaaatgattcaagaaaagaatttgggaatacagctttatttgggaaatgagattttttacagttcaggagttttagaggcattgaaaagaggagaagcattaacattaaatcatacgaagtatgtactggttgaatttgcaccctatgtggaacttctgacgataaaaaaggcagtgcaggaacttcagatggcaggttattttccgatattggctcatattgagcgatatgagtgcctgaaaaaagaatcggaagtacaaaatcttgtagatatgggagcttatattcaggtaaatgcttcaagtctgacgggacgtctgggaatccgagtgcagtggtatctaaaaaaattaatgcggcatgacttggttcatgtcgtagcaacagatgcgcatggctcgaagaagagacgccctatgatacaggaagcagcaggatatatcaagaaaaaagccggagcagactactgtaagaaaataacagaagaaaatccggaaaaaataattagaggagagaggatttgtggataagttagaattaacagatgcaaaagaactgacaaatcaggaaaaagaagtgtatcgtacgttacggacaaatctggaatttacaggagtagaaaaccgtgtaattgcggttacgagctgtggaccggatgaaggaaaaagtacggtgtcttacaatcttggacgcactttggcttccgccggaaagacaacgttatatattgatgcggatatgagaaagtcaattttggcaaaccgacatcagattcaggggattgaaaaggggttaagccattatctttccggtcaggctgatatgacagaagttgtatactcaaccaataaaaagaatttctttatgcttccttgtggtctgtttccggttaatccaaccgaacttttaggaaatggaagactggacaaactattagaaggtttaaagaaaacatttgactatattattattgatactccgcctcttggaagtgttattgacgcagcagttgttgcaaaacgttgtgacggttctgtattggtgttagaagcagaccgcacaccaaaatcaatggcaaaaagtgtaaaagaacagcttcaggcggcaaatccgaatatcgtaggtgtggtattgaataaagtagatacccataaaggcagctattatggtaaaaaatatggaagctactatggaaaatattacaaataataaatacattgtgccagcacaatagaaacaggaaaagaggtacgaaatgaataaagaatacgatgacgaaatcgagattgatttaggtgcgttatttcaatgtcttctaaaaaaatggtggctgattgtaatctgtgcactgattggagccggacttgctcttggaagtaccattttactgattacaccaaagtatcagtccagtgccatgctttatattttgaataaaacaaccagtgtaacttctcttgccgatattcagattggtagtgcactgaccgcagactttgaagtgattgcaacaagtaagccggtaattgacggagcaattgaaacgttaaaaaaagaagaaggtaaaacatttacaagagagcagatttcaaaaatgctttctattaccaataaagaggatacccgtattctggtgattacagcaaccagtgaaaatcctcaggatgccagtattgtggcaaatgcggtagcaaaaaatacagcgactaaaatgggtgagattatgaaatctgatccgccgactactgtggaaaatgcagaaacaccgcaagattcaatcagtccaagcttgaaaaagaataccattttaggatttttggcaggagcagtattagtctgtgcaatccttgtcatccagttcttattaaacgataatattaagacagaggatgacattgaaaaatatcttggtctttctactttggtagcaattccaaaagaaaagggaaagagtagaaagaaacaggaagtcagacagttaaaagagggttctcatgaaacaaagaaataaatggttctgggtgttttttgtcatttttgtaattgcggttggagttggagcaggatattatttcgggcaaaaagaccgtgaacaggtttatgaagacctggctgagaaaaataaaaaaccgcaggaagaaacgaaacaggaagaacagacaacagatgaaccggcagaagaagaaaaaacagtagaaataccaatcgatttttcttctttaaaagagaaaaattcagaggtttatgcatggattcggataccggatacacaggtagattatccgattttacaaagagcatcggatgacttatattatctggatcataccattgatggtgccgagggacttccgggttctatctatacccagagtttaaattcacaggatttttcagataaaaatacggtgatttatggtcataatatgagagacgagaccatgtttggaggtctgaaatcttatatggatgaatcttatatgaaagctcattcgcagattcttatttatacaccggaacatattttgacctatcaggtatttgctgcggttacttatgataaccgtcatattttaaattcattcgattttgaatcagaggaaggatttcaggaatatctggattcattaaaagaagtgagaaatatgtcatcttatattgactctgatgttgaagtcacaacagaggataaaattattacattgtcaacctgtaatggaaacagtgatcagagatttctggtggaggcagtgcttgtaaatgaagaataagagtggaaaaatagtagcggtggcagtgcttgggattgccggaatcttatgcattgcactgctgacagcaggataccttaaaaaaacatcagaggcaaaaaaggtatcccaaaataagcagacatcgcaggcagaggtttcacaggcttcggataatacaattgaatataacggacataagtatgaatataatacggatttggaaaactatctgtttatcggtgtagataaacaggaagaagtaacccttcaagatacacctggaacagcaggtcaggcagactgtgttatgattctttcggcaaataaacaaacaaagaaagttaaagtgcttcaagtatccagagactctatgacagatgttgatatttacgatgcaaacggaaattattatacgtcagtgagagctcagattgcgacacagtatgcctatggagatggaaaacaaagcagttgtctcgcaatggaaaagacggtttcggagttgctatatgatttgccgattgcagggtatgtttcgcttgacattgcagggattcatgcaatcaatgatgcggttggcggagttacaattacggttcccgaagattatacttacattgactctgcgttccaaaagggggctgaaattacattgacaggggatttagcagaactttatgtaagatatcgtgatattaatcaagaaggaagcaataatgaacgtatgagacgtcagacccagtatattccggcattgatttctacgattcggaaaaatacaagtgggattgcaagttattataatctttataaagatgtacttgccccttatatggtaaccgatctgggagaaacccagattgatcggctctcttcttatgagttggaggaagagacagaatatgtcccaggtgaagtcgtgccaggggaaatcaatgaagaatttcatgtaaatgaagaacaattgcgtgatttgttgataaatatgttttacaaatcagttcaataatgctataatgagcgcaaagcacaaatagaaatttaggaggaaaatgattatgaaaaaatttatcgctcttgcatgtgcagcagtattaaccgtagcatcagcagtgacagcgtttgctcagccaagtgtaagtgtatctggtgtagtaacagctgtaacaactgctacagataaagatggaaaagctgtaaatgcaacatttggtgaagtaccggcagagtatgccagtgcagttgctgaagtaaaaacagaagcaaaattaaaagaactgcttggttctgactatacatctacaatgcaggttgttgatgtgaaaaatgtaacagttccggatggtacagtattccctgtaactatcacattcaaagtaacaggtgtaacagcttctacaaaagttgcagttcttcactacaacacaacaacaaaagcttgggaaaaagtagaaagcaaagccggtgatggtacagtcacagctacctttacttccctctcaccggtagcattcgtagttgacaaagcaacagctgcttctactacaactacaaacaaaggaacaacaactactacaaataagggaacaacttcttctactacagcatctgcatctacaacatcaccgaaaacaggtgaaacaaatgttatgatgtatgcaggaatcgtagctgtagcagcagtagcaggaatggctgttacaagaagaaaacgtgcttaattaactacatcatatagttatagcagctataattaagaaataaaaagtccgggtatggtgcttcccggacttttttaatttacgggaaattctgttctatgaggtcaagtggatattcgcaatccgcttcgctacttgctcataaccaaatagctgctacgcagcttatcagaaggggcttgccccctcctgatacaagcaagtccccacccctgcttattgcttttcgcaattgaagcaggggacttacttgatttggttaaaaaacacttgcattttgtcgtacttcatagtataatcaaatacgttgtaaaaaaagagatggtcctctgttgttgattacattaagaacatccggaagaataaggagaaaaatcatgaacgaaattatcaaaaacattgaagatgctcagttaaaagcagaagtacctcagttcaacgtaggtgacacagtaagagtacacggaaaaatcaaagaaggaaaccgtgaaagaatccagatttttgaaggtgttgtattaaagaaacagggtggaagcaaccgtgctactttcacagtaagaaagaactccaacggaatcggtgttgaaaaaacatggccacttcactccccgaatgttgaaaaagtagaagtaatcagacgtggtaaagtaagacgtgcaaaactgaactacttaagagaccgcgtaggtaaagctgcaaaggtaaaagaattagtaaaataataaaagttagaggacagggacacatacttatgtatatgtcccttttcttccatcttgaggaaaaaaatatgagtaagaaaacaataagaaagccggcttttttgggaaaatataactggaaagcaatccttccatggatatttcagattgcagttgttttggcacttgcagcgatgatgtctattttcttttgtcagagtgtgattatgcaggagagcagtatggagccgagtatcgaaaccggacagcatctgctgatgaataaggtaacgtataagttaaaagaaccacagcgtggggatgtgattgcatttaaaaaagatggcaaagaacattccagtattcatgtaaagagaattattggactccccggagaaaaaattcagattaaagatggaaaagtctatatcaatgggaaactctataaagaaaaaaattttccaaatattataaatccggggcttgccgaacagcagattacacttggaaaaaatgaatattttgtacttggggataaccgaaataacagtgaggacagccgttttacagaagtacaaaatgtgaatgcaaaatatattgagggaaaaatctggcttcagatttctccgtcaaagaaaccggctttgattaaatagcgtaagcagcagaatcagcagaaagagaggcagatatgaattatcaatggtatcctggtcacatgacaaaggcaagacgtatgatgcaggaaaacattaaacttattgatttgattatagaagttgtcgatgcgagaattccgctttcaagcagaaatccggacattgatgagcttgggaaaaataaagcacgtatgattttgttaaataaatctgatttggcagatgaacgtgaaaatgaaaaatggcaggaatattttacccaaaaaggatttcatgtggttaaaatgaatgcaaaaagtggggcaggtgtgaaaaatgtactgccggttatcatggaagcctgcaaagaaaaaattgagcgtgataagcgaagaggcattaaaaatcgtccgattcgtgcaatggtagtgggaattccaaatgttggaaaatcgacatttatcaatgcatttgccggaaaagcctgtgcaaaaaccggaaataaaccaggtgtgacaaagggaaaacagtggattcgcattaacaaaaacgtggaattgttagatacacccggaattttatggccgaaatttgaagatcagagtgtaggtgcaaagctggcaatgattggttctatgaatgaccagattttaaatttggaagaactttcactggaattattaggctatcttcataaatgctacgagggaatcttggcacagcgttatgagttagaagaaagtgaagatcgtcttgctatgttaagtgcagttgctaaaaacagaaactgcttaaaaaagggaaatgaattagattatgcgaaggcttctaatattttactcgaagagtttagaaacggtaaaattggccggattacgctggaacaggcttaagggagaataaaaatggaaagcattcgcgagataaaagagaagcttcagtctgcatggacagaggaagaagcaagtaaagactggaaggaaagtatcaaaagtccactgaacgagtttctcacaagttattcagaggataccagaaaaggtgtggtttctctttgtgaaaaggcaaaaaaagagttcaaaaaactgcatgcagaacgagaacgaattgagtcattaaaggtctatgaacgggaatatgaacatttaggatatatctgcggaattgatgaagttggaagaggtccgcttgccggtccggtggtcgcaggagctgtaattctgccaaaggactgtaagttattgtatttaaatgattccaaacagctctcagagaaaaagagagaggaattgtacgataagattatggaagaggcagtcgcagttgcggtcggatatgcgagccctgcaaggattgatgaaatcaatattttacaggcaacttatgaggcaatgcgggaagcaatttcgaaacttgaggtgacacctcagattttattaaatgatgctgtcacaattccggatgttattattccacaagttccgattatcaaaggagatgcaaagagcatttcgattggagcagcgagtattatcgcaaaagtgacgagagaccgtttaatgaaagagtatgcaaaactgatgccggaatatgactttgcttctaataaaggatatggttcgtcggcacatatttcggcattaaagaaatacgggccttctccaattcaccgtgcaacgtttattaagaactttatataggatgaaattgtttgtagatgcagagagaagaaaaaaatacgcggagaatcggtgcttattatgaagaacaggcagcacagtatcttcaaagtaagggatatacgataatcaaacgaaattataagacaccttatggcgagattgatttaattgcaaaaaaaccggatttactggtgttttgtgaagtgaaatttcgaagcagtgaccgatatggaacgggacttgaagccgtaacggtaaaaaaacagcagagaattatcaaatctgcccgatatttttgtaattggtactgtggttcaaaagaatttgcttatcgctttgatgtgattgccattgaaccgcaagaaaagatttgtcatattgaaaatgcgttcgaattgtaaaataaagagttgattcatggggagtggagttatggataatggaatgatagagaaaagtaaaaaaatacgatggaaaacggatgaatacatgaaaacggtagaaaaaaacggtgtaacctatttaaaatatcggtcgtttgagccatttgagaaaaccatcattcatggattttccactcgtcttggtggtgtcagcaaggggatttatgaatccatgaacttaagttttacaagaggcgatgaggaagaagctgtttttgaaaattatagacgaatttcagaagcgattggatttttgccggaagatattgtgtgttcggaccagacccatacaacgaatgtacgaagagttggaagggcagacaggggaaagggaattgtaaaagcacgggattatacggacgtagatggtttaatcacgaacgccccgggaattgtgcttgcaactttttatgcagactgtgtgccattattttttgttgacccaaagaatcgggcgattgggctttctcattccggatggagaggaacagtcggaaaaatcggaaaagtaacggttgaagctatgaaaagagagtttggttctaatccggaagagatttatacagcggttgggccatctatctgtcaggactgttatgaagtgagtgaggatgtaattgttcagtttgaagaacagtttaaaaaagaaagccataaagatttattttacaaaaaagagaatggaaaatatcagctgaatttgtggaaggcaaatgaactggtcttcttagaagcaggaattaaaccggaacatattacaatgcctggaatttgtacctgctgtaatccgaattttttattctcacatcgtgcaagtcatggaaaacgtgggaatctggcggcgtttcttggattgcgcgaaaatcaataggctaaatgcataaaaattttgctgcttttttaagggatattacatagttgttacaaaatatgaaaaaaagactaggaatctgttaagaactgtgttataatcaagttcgtgatttgaaaaggagcttagattatgagaaataaaacatgtagaagtttatttttgtctttactgattgcaggacttaccgtaacaccttgttatgcagcaacgacacaaagtaaaatttctgatgcacagagtaagaaacagcagactcaggatgatttaaaagaagcgcagagcagaatttcttctctggaagcaaaaaaagatgatttacaagcttatttaacagaactggacagccagctctcagatttagccgataatctttcagatttgcaggaaaaatcagatgctaagcagagtgaattagaagaattaaaaaccgaattagaggcagcgaaagaccgtcagaatgaacagtatgaaagcatgaaattaagaattcagtatatgtacgaaaaatcaaatgattcttacatttctatgttgctggaatccaaaaatcttacagagtttttaagtacagcagagaatatcatgcagattaccaagtatgacagaggaatgttagcagcatataaagaaacacagcaggaaatcgaagaaaaagaagccagtgtggaaaaagagcagagtgcaatcgaagcacttcagcaggaaagtctggaaaagcagaatgaaatcgctgacttaatgaaaggaacaaacagtcagattgaagcttatacttctgagatttcaaatgaagaaaacagtgctcaggatttacttgcaaaagtaaatgcacaggaagcagaaattgataaattaattaaacagcagaaagatgaagaagcagcagccgagcttgcaaaacagaaagctgccgcacaggcaaaagcagctgaggaagcaaagaaacaggcagcagaagccgaaagagccgcacaggcaaaagcagctgaggcgcagcagagtgcaagtcagagcagtgcttcaagctccactcagcagactacagaatcttctgcttctacgaatacaaatacaaccgtaacagaaacaccaagtcaggaagaaaccgtagaggatacaagcagttctacaacagaagatacaaatgattcttcaagcagctccggcgattcttcttccagctctcagggaacttaccttggtaaatttaccattacaggttactgtaactgttctcagtgtggaggacagggtctgacagcaagtggaacagtaccgactgccggaagaacagtagcaatgaatggtattccatttggaacaaaattgttaatcaatggagtagtttataccgtagaagaccgtggtgttccttatggacacgtagatgtatattacgatacacatagtcaggcacttggaaacggaagatattacgcagacgtttaccagttaaactaagaatatagacagtaagaagaaatacataaaaaaacaaaagagaaatcgtagccaggaaaggttatgatttcttttttgttgaaagaaaaagcagacagagcattaaactctgtctgcctattaagtatgaattaagaataacgatgaagcaactggttaatcttttctgttgtagaacgaactttttctacagagaggtcatggtttaagatatccataatacttgccagatatttgctcatgtctgcctcaagataataaggacgggtgagaatgtccggatttttgtagtttaagtttgttgtgattactttatggatgtattctttttcgtaaaattcatcaaatttttcaagaccatcggtgaaaagaccaaaagtagtgcagacgataacacgttttgcttttctgtcttttaattgttttgcgacatcgagcatgctttcaccggaagaaatcatatcatcgattacgataacatcttttccttcaacagagtcacctaagaattcgtgagcgacaatcgggtttttaccatttacaacagtagaatagtcacgacgtttgtagaacatacccatatcaacaccaagaatattagagaagtataccgcacgctgcattgcaccctcgtccgggctgataatcattaagtgctcgttatcgattttaaaatcatctacagaagcacataatgtttttaaaaactgataggtcggcataaaattgtcaaatccggaaagcggaatggcattctgcatacgcgggtcatgagcatcgaatgtaatgatattagaaacacccatgtttaccagttcctgaagcgcaagtgcacagtcaagagattctcttttggttctcttatgctgacggctttcatagagaaatggcataatgacattgattcgatgtgcttttccggttgctgttgcaataattcgttttaagtcctgataatggtcatcaggagacatatgattgatatatccgttgactttataagtaagactatagttgcagacatctaccataacgaaaaggtcggtaccccgtacagattcattaatcacaccttttgcttctccggagccaaatctcgggcatttgctttcaattaaaaaagtatcttctgaataacctcgaaagcttaatccggatttattgtgggaatctaactcctgtctgaattgaacaagatgagaatccaccttctgtgccagttcatggcagctgtctaaggctgcaattttaatcggtgctactggaatggatttctccagcaaactgatattaaccataatgacctccaaattatattttttaaatttgattattaaaataccagaaattatttaaaacaaaaacatttctgatatcagttgtagataaaatagtgtttatcccaacttttcgacataattatacaattaagttataacatttatatatcatggcagtcaaggaaaaatattgctttttttcggtattgttggtattatagataataacggggtttaaaagcttcgtttggaaatgaggatagatatgaaacaaagcagacataaaatcaaagaaatacaagaaggaagcatcgcacaggaactggaattagaagctggagacgagctgatttcaattaatggacagccggttgaggatgtgtttgactatcactatctggtaaatgatgaatatatagaacttctggtaaaaaaacaaagcggagaagaatgggaacttgaagtcgaaaaagactatgatgaggaccttggaattgtgtttgaaaatagtttgatggatgaataccgttcttgtagaaataaatgcgtattttgttttattgaccagatgccgccgggaatgagagaaactttgtattttaaagacgatgattcccgactttcttttttacagggaaactatgttacacttaccaatatgagtgaccatgatattgaacggattattcattatcatcttgcaccgattaatatttcttttcagacaacgaacccacaactgcgttgcaaaatgctgcataatcgttttgcgggagacattttcccaaaagtgcagagattgtttgaagcaggaattgagatgaatggacagattgtactttgtaaagggttaaatgataaagaagaacttaaacgaagtattaaagatttatcaaaataccttccgcatttaagaagtgtttcggttgttccggtgggattaagtaaattccgggatggactatatccgcttgaaccgtttgaaaaacaagatgcggaggaagtcattgacttaattgaatcctggcagaaaaaactttatgaagcttatggactccattttattcatgcaagtgatgagtggtacctgttagcaggaagagaactgccggaggaggaaagatatgatggatatctccagctggaaaacggagtcggtatgctgaggcttttggaaacagaggtggaagaagccttagagcagagagagggagatgaacgaaaattagaactttcttttgcaactgggcggttggcatatggatttatcagaaaatatatggactggattcaggagaagtatccaaatgtcaaagttcacggttatcagattgtaaatgatttctttggtgaaaaaataacggtatccggtcttttgacaggacaggatgtaattgcacagttaaaaaataaagaactgggtgaatatctattattaccttgtaatctgcttcgaagtggagagaatgtatttcttgatgacaggacagtagaagaggtagaaaaagaattaaagattcctgtaaaaatcgtagaagaagacggcgcttcattagtttccgctgtcttagagaaagacgcaggaagagcacatagaaggagacagatgtatgagcaaaccgattgtagcgattgtagggagacctaatgtaggaaaatctacgttatttaatgcacttgccggtgagaaaatttcaattgtaaaagatacaccaggcgtaacaagagaccgcatttatgcagatgtaagctggctggataaaaactttacgttaattgataccggtggtattgaaccggacagcaaagatattattttgtcacagatgcgtgaacaggcacagattgccattgatactgccgatgttattatttttattaccgatgtacgccagggactggtggattccgatgcaaaggtagcagatatgctgcgccgcagtaataaaccggttgtactggttgtcaataaagtggacagttttgataaattcatgatggatacttatgaattttataatctgggaattggagaaccggtgccgatttctgcaagtggaaaacttggaattggtgacatgttagagaaagtagtcagtcactttgaagagggtgcaggtcaggcagaagaagaggaaattccgaagattgcggttgtaggaaagccaaatgtgggaaaatcttctctgattaataaagtccttggagaatcccgtgttattgtttcggatattgccggaactacaagagatgccattgatacaaaagtagaatggaatggaaatgaatatgttttcattgatacggcaggtcttagaagaaaaaataaaattaaagaagaactcgaacgatacagtattattcgtaccgtaaccgcagtggagcgtgcggatgtcgtcgttatgatgattgatgcaacggaaggggtaaccgagcaggatgcaaagattgccggaatcgcacatgaaagaggaaaaggtgtcattattgcagtcaataaatgggatgcaattgagaaaaatgataagactatttataagtttactaataaagtgcgtgaaatcctttcttatatgccttatgcagaaattttatttatttctgcaaaaaccggacagagagttccgaaattatttgaaaccattgatatggtgcttgaaaatcagacccttcgtattcagaccggtgtactcaatgagattatgacagaagccgtggcaatgcagcagccaccttcggataaaggaaaacgtctgaaattattctacatgacacaggtttctgtaaaaccgccaacatttgttatttttgtaaatgataaagagttaatgcatttttcttacacaagatatctggaaaataaaatcagagaggcctttggatttaaaggaacttctttaaaattcctgattcgtgagagaaaggacaaggagtaacaaaaatatgtgggcgaaaatcgtatgtcttgtaatcggatatggattcggattgtttcagaccggttatttttatggaaagagaaatggaattgacatccgtaaatatggaagtggaaatgcaggaacaacaaatgcactgcgtacgcttggaaagaaagcaggagcaattactcttgcaggagactgtttaaaagcgatcttggctattttactggtcagtctgatttttggaagagcatttccggaacagattatgcttttaaaattgtatgccggagcgggttgtgtattgggacataatttcccgttttatatgaattttaagggtggaaaaggaatagcagcttctgtaggaatgttaattgcatttgactggcggttatttttcttatgcgcggttgtattttttaccgtatttttcttaagtcattttgtttctctggcatctttgctggcgtatttcttttttgtcgttggagtgattgcttctggacagatggggcgttatgatgtacctgcatcggtgcttcatgaaatgtatattgttgcatttcttttgatgcttctggcattttggagacatcgtgcaaatatcaaacgactggcaaccggaaccgaaaacaagattgaatttggtaaaaaataggaggtatttgggtatggcaaaagtgagtgtagttggggcgggaagctggggaaccgcgcttgcaatgttattatgtaataatggacatgatacaatgctttggtcacacagagaagaacaggcagaggaattaagaacagcaagagaaaataaagcaaaactgccaggggttaaaattccggaagaaatccatgtaacttctgatttatcggaagctttgattgataaagatgtgattgtaatggctgtgccgtctgtggcagttcggacgacagctaagaaaatgtcttcccatatccggtatgggcaggtcattgtcaatgtggcaaaaggaattgaagagggcagtctgatgacactgaccgatatgatagaagaagaaattccaaattgtcaggcatgtgtgctttcaggaccaagccatgcagaagaggtaagccgtggtcttccgacaacctgtgtagtcggggcaaagacaagagcacttgcggaatatctgcagaatatttttatgagttccgtatttcgggtttatatcagcccggatattttaggaattgaactcggagcggcattaaaaaatgtgattgcgctggcagcagggactgcggatggattaggatatggagacaatacaaaggcagctctgattacccgtggaattaccgagatggaacgtcttggtgtggcaatgggcgcaaaggcggaaaccttttatggtttatcgggtattggagatttgattgttacttgtgcaagtgttcacagccgtaatcgaaaagccggtttcttaatgggacaggggagaaccatggaagaagccatgaaagaagtaaatatggttgtagaaggtgtttattcagcaaaagcagggatggagcttgcaaagaaatatcacgtggaaatgccgattattgaacaggtcaatgaagtactgtttgaagggaaaacaccggcggatgcagtaaaagagctgatggttcgtgataagaaaatagaaaactgggattttgaatggtaatttacaaaggagtgtactttaaagggaagtgcactcctttttcttaagaaacattaaggggcttttagaaaaattttcgatttgtgcaaataaattgtaaaaaagaattggtatgataaaagagtaagaaaattgagagctgttctcaaagtctttatacatatatttatgaaacaggaaaggaagtctagatggaaaagacgctgatacagttaaaggatatttgtaaagtttataatcctggagaaaatgaagtgcgagcattagaccatatcaaccttgagatcatggagggcgaactggtagcaattattgggcagtccggttcaggcaaatctacgctgatgaatatgctggggtgtctggatgtgccgacaagtggttcttattatcttcatgggcaggatgtttcacatttaaaagataatgaactttctgcaatccgcaataaagaaattggttttatttttcagggatttaatttgattgcaaatttaaatgcagttgaaaatgtggaacttccattaatttatcgtggaattggaaaacaggagagaagaaaactggcaaaggaagcactcgaaatggtaggtcttgggcacagaatggaccataaaccatcggagatgtccggaggacaacagcagagagttgcaattgcaagagcaatcgcagcaaaaccgccggtgattttggcggatgagccgacaggaaatctggattctgcttcaagtaaagaaattcttcagattttaaaagaccttcacagcggaggacgaaccgtgattctaattacacacgatgacaaaattgcggaacaggcatacaggattatccgtattttggatggaaaaatagaatctgaccggaagaatgataaaatattggaaagcagagaggaaataaaatgaaaaaaagaaacgtaaaacaactggcgggaatgtcctcaaaaaagaaaaagtggattattgttggagcaatagtagtagtcatagcagtcggtgcagtaagtgtgtctggaagaaggcaaaaagattcattgccacaggttacggtagaacaggcgaaaaaacaggatgtcacttcaagggtggagacaagtggaacggtagaaagcctgaaagtgaagacttatttttcaccggtcaatgcgacaatttccagtcttggttatcaaaccggtgatttggtaaaaaaaggagatacactggttgcgtttgaaaccgattctttagaacaggataatgaaaaaagccagttaaataaaacagcaacggtaagtggttcaaaagatacagcacagaaagcggtagagagtgcacaaaaagtaaaagatgcacaggcagaacttcccacattggagcagaatgttaaaaattatcaagagtatgtggcgtctttaaaaacagccattgcggaccgtacccgcacacttgcggaagattcttcaaaggcttcttctgatattagtatggcattgacaaaagcacaggcagaactggcaaaaatgcaggagaatatgtcgagccttactgcattgcagcaggagcaggaggcaaaaattacagagtttacggcggaaatctcagagactaaaaaagaaggtggagatacttcggaggcggagcatcaattaaataatttcaatgatgccttaaagcagacaaaaaatcagataaaagaacagcagaattatattgatgaacaaaatgatgtgattacacagttaaatgtacagcagattgaagcacagagtaatgtaaaagatgcagattcagatgaacagattgttgcatggcagaatgaattagaagatgcgacaacaaaactttcagaattacagtctgaactttccgaaaagaaaacggtagcagaaggttcttctgatgctgaactgactcaggcagcaaagaaccagttggaggcaacggacaatctcgcagaattagaggcagcaagtacacaggagttattagaaaaaggccgtcagggaattaaagcagattttgcaggaattatttcaaaagaagaaatttcagaaggaacaacagcgacgcagggaatggaactggtaacggtttcaagtaatgaagaagttgcagtaaacgtcagtgtatcaaagtacgattatgataaattaaaggaaggtcagaaagcttctatcagtattgcaagtcatacttatgcgggaaccgtttcatctatcagcaaggttgcccagacaaatgaaaaaggtgcacctgtgatttcggcaaaagtaaaaattgacaatccggacgaaagtattttccttggggtagaagcaaaagtttcgattgagacggatactgcaaaagatgtggtatgtgttccagcctctgctgtgaatacagcgactgacagcacgttttgttatgtgttaaaagatggagtgattacgaaacagaatattacaacaggtgttacagcgagtgattacatagaagtagaaaagggattaaaggcaggagatgaagtgatttcagagcttccagaaggcgtagaagcaggaatgaaagcagaggcggtaagtgggagtacagaggaatagcgatgggacagacatttgagtatctaaaaatggctctgcaaaatatcagggcaaataagggacgttccctgctcaccatgcttggcatcattattggaatttcttcggttattacaattatgtcggttggagcgggctttaaaaatgaaatgaataaacagctggactccattgcaggaggacagatttatctttatttaagcgatgaggggcaaaaaagagaagagtatatgacagaagatgattttgctcagattgaatcaaagatagatggggtgacagggacttctccggtctttggcgcagcaggttcaactaagacattaaaaggggaatttacggtcaatcttaccggaggaggaacggcacagcaggaaatctcaaaatggaaagtggtaagaggacggtattttaatcaaagtgatattgatacggcaaaccgtgtctgcgtagtcagcaaaaaagatgcgatttccatgtttggaacagacgacgtagttggaatgaatatcgaaattgcatcggataacagtaccggtgattttcaaattatcggaattgtagaacaggaaaatttaggaaacatggtcacgatggaatatggagatgaacagagtgtgtctatggatgttccgtatacggcaatggatgtatttggatatgatacttcttcatttgcatatctttatattacaacggacaaaagtgcggacactggaaaggttgcaaatgcggcaattgcacttttaaatcaattgcattacagttcgggagaaagctattatgatatggaaaattttacggaccagatgtcatctatcaatgatatgctgaatatgattaccggatttatttcgctggttgccggaatttctcttttggttggtggaattggtgtcatgaatattatgttagtatctgtgacagaacgtacgagggagattggtatccgaaaatcattaggagcaaaaacttcttcgattatgatgcagtttttggcagagtcggcaatcattgcctgcattgggggcttaattggaattacaattggtgtggcacttgcttatgcggtgtgttcgattccaacacttggttttacgccgggaattaaattatctaccattcttttggcaacggtattttcttccggaattggaattgtgtttggagtttatccggcaagaaaagcagcaaaattaagtccgatagaagcgcttagaagaaactaaatattgagaaaaaagaaattagaaaaatataagagcggagaaaagaaaaatgacaggaatcatataaaaaaattcctgtcatttttttagtcctgataataaggaagcatgtcttccggaatgccggcagttctttgtttgatgtccattgcattaatcgcattcatttcttcttcggttaaagaaaaatcaaagatatctgcattttctaaaatgcggtctttatgagtggattttggaattgcagatactccctgctgtaccagccagcgaagtccaatctgagcggttgttttctgatatctgctgccgatttctaagagaagctggctatgcagataagcacctctggcaagcggagcataagcctggacggcaattccctctgatttgcaataagaaagcagttctttttgattgaacagaggatgaaactccacctgattgacagcaggtttgatatcggaaaccgattttagtaattctaattcatggatacggaagttagaaacaccgatggatttgatttttccagcagattgcaatttttccagcgttttccatgtgtttgtgaaacatccgggaaccggccagtgaattaaatacaaatcaacataatcaagtccaagtctttccagacttctgttaaaactatcttctacgtcaccaagacgctgtgcattattccatatctttgttgtgataaataattcttcccgtggtacatcaagtgcttttaaacctcgtccgactccgtcttcatttttataaacagaagcggtatcaatcagacgataaccagagcagacggcgtcttgaatggcttgttccacttctgttccggcatctgctttgtatactccaagtccgagaagcggcattttatgaccatcatttagtaaaatggtattttcaccaagtgacatgaaacagccctcctttactcttaaatctacacttcgagtctttctatgtttattgaaaagtgtcgagcatagatttcttttcctactttaaactacgccttatcttatcataaagatatgaagtaattactccaaatttattaattttttaataaattcatgttattattaaaaaaaggagttttaaaattatgaaattttttcatttggcagatttgcatttaggaagaaaattattaggggaatctttgatagaagaacagagttatatattagaagaaattatgaaaaatgtccgtgtggaaaagccagacggaatctttatctgtggagatatttatgataaatatattccgtcctcggaggcagtggcattgtttgattcttttttagaggctcttgtaaaagaaaattgtgaagtatttattatcagtggaaatcatgacggagcaagtcggctcgaatttgcaagtggattattaaaaaagcagaaagtccatatctgtgggacttataagggaaagatagagagtgtggaacaaaaagatgagtatggaaagctgacggtgtatctgcttccgtttttgcgtccggatatgttgagagcttatgaaaagaactgtccccaaacttatcatgaagcagtaaagcaagtgctgaaagatctgtcttataataagaaagaacgcaatcttttactgactcatcagtttgttgtggacggacaaatgtttcccgaaacttcagaatcagaaataaaattaataggagggatagaagcagtagatgtatcctgttttgaaagatttgactatactgcccttggtcacattcatcgggcacagaaaataaaaacggaatggatacgatatgcgggttctccacttgcgtattccttttcggaagtaaatgataaaaaaggaattacagtagtggaattaaaagaaaaaggaaattgttctgtgcgaaagattttgctgcatccaaaaacgaaactggcagttttaaaagataagctggaaaatttactttctgaagcctatcaggaattccggacaggctattatttatcaattcgagtgacagacgaagaaatactggagtatccggtgcagagattacagcaggtcttttcgggaatgttggaatgtcggattgaaaaccgtagaacgttggctcagggaattatggaaacggcggatttgtctgctataaaaaaaacaccggagtctctctttgctgaattttatgaaaagcaaaatgggatacctatgaatgaaatcgaaaagcagatactaagaacggtacttggtgaaatggaggagatgaaaggtgagaccaattgagttggaattagaagcgtttggaccttatgcagaacgcacacagatttcatttgaacaatttcaggaaaatggattgtttttaatttgtggagataccggttctgggaaaactacgatttttgatgcaattgcatttgccctttatgatacggcaagtggagagacgagaaagatggaaacccttcacagtgattatgtagaagcaaaaaagtgcagtgaagtaagactattattttcgcataaaggaaagcgttatcaggtaatccgcagttttaatggaaaacgaaaaaatgaagcggtattagaagaggagaaaaaagaaggattaaccggacgaaaagcggtaaacgagagaataagagaaatacttggacttgactatcagcaatttaaacagatttcaatgattgcgcaaggagagtttttgagtttactgcttgcaaaaagtgaagtgcgcagtgagattttcagaagagtatttgataccgaactttataaaaggctggcagaagtattaaaaagtaaagcggttcatttaagagaagaggagaagctgcgaaaagaaagagaacatcagctgatgtcaggtctggaagaagaattagaaaaagaattcaaaaaagaagatgagagctggcagatcccagaagaaattgaaaagattttagaaaaaaagatagaagagttaaaagaagaagagaagaggcagaaaggggtagagaaagaagaggagactgataaagcggaaattttaaaagccctggagcagataaaaacgataaatcgggattttcaacagctggaaaatttgcaggaaattttgaaacaagaaaaggaaagaaaaagagagtttgctcagaaagaaaaagaactggataagataaagaggggggcgctttatatcaaaccggttttggagcgatatgaggaaaagaaaacagcacttgagacagaagaaatcaggtatcgggaaatttgcggaaggcagaaagcacaaaaacagaatacaggaaaattaagacaagaacaaaaagaggcggaacaaaataaaagaaaatacgaaaaaatacagtgcctgaaagcggaatgtctggaaatagagacagaatataaaaagctgaatatactttgtgctctccaaacggaaaaagaaaaattacaggaacagttaaagacagaaatcagagaagcaaaacaggcagtggttgaatatgaaacagaaaaagaaaaatttttctgtgcgcaggcaggaattctggctaaagctttaaaagagggagcgccgtgtccggtctgtggttctgttttacatccgcgtccggccgttgttttaggagaagtacttacccaggaagaactaaaagaaaaagaacgtaagaagaaacagttagaagagaaaagacagcgaaccatgcagacatttttacagctggagaaagaagtagaaaaaagtacaaaagagatatcggtaaacccggattttttctggaaagaagttcatgcaaaactagaacagacaggacaaaaaagaaaccagaaagaaataaaaatcagagaacttgaacaagatgtaaaaaaggaagtgagagacagtgagacaatccaaaaagagtggattgaaaatctggaaaaagaagcgggaatcttaaaagaaaaagaaatatgcaaagagcagatagaagcgttaaaagcagagaaaaaagcatgtcagatgaaattaagaactgcggtaaaagaacaaaagtttaaaagtgaaaaagaagccagattattttgtgaaaaacaggaaaaacttttgaaattagagcaggaaattgcagattacaaaaaaaggcttcacaagtttttagggcagataaaaattttggaaaaaacgcttttggggcaaaaaaaacagtcggaagaagaaaaacagaaaaagcttgaacagacagaacaaaatctggaaaaaatcaggatggaattaagagaaatttataaacgtatcagtttttatgaaaagaccttagaacagctgaaaaaactgtgggaagaaagcgaaaaaaccagaaaggaaagactggcacttttgtcactttcggatacggcatccggaacacttgcaggaaaaccgaaagtatcctttgaacgctatgttcagtctgcatatttcaaacaaattgttgtggaagcaaaccagagactggaacagatgacagatggcagatatgagttgttggtagaggagacgggaacaaacaaaaaaagccagagtggtctggatttgcaggtatacgactatcataccggaaaggtaagaagtgtccgttctctttcaggtggagagagttttcaggcagctctttctctggcacttggagtgtcgggagtcataagtcagtttgcggggggaatttgcatagaaaccttgttcattgacgagggatttgggagccttgatgagcagtctttagaacttgctgttgatactttgcgtcagctttcgggtcagggatgtatgattggaattatttcgcatgtaaaagaattaaaagagcagatttttcatcggattgagataaaaaaaggacagaaaggaagtcagattttaacagtggtctgaacctttaaaaaaacataagaattgcttgataaaacggcaaaaaacatgtataataatggtattgataaattattgtcatttactgcgcccaattaaaattaagctgcagagaaaggagaaaaaatgcatttaattaatgatgaaaacggcaatgtcgttcctcatgggcatgagcataatcacagccacgaacatacgcatggacatgcgcatgaacatggatgcagcaattgtggtgataacgagtgtcagggaagctgtacagaagaagtggtagcacttttaaattatatgctttcccacaatgaacaccatgcagaagaacttgaccagatggcagaaaatcttgcaaaactgggaatggaagatgcggcaaaaacgattaaagaaggtgttgcggatttccagaaaggaaacatgcggttaggtcttgcactgacacttgtgaaagaacatttgaaggactgaaattaaggaggcgtaactatgtgtcttgcaaccgttcaaaaaagtgatgatactgtagtatgcagaaatgtcagcagaattgatgtggatggagaaaaggtaatcattcgagatattatgggtgatgagcgcgtaatagaaggaaaaattcttatggttgatttagcaaacagccttgtaaaactggattgtcagtaaaaacagatctttgagactgctacgcacagtcttgaatagataaattataatgtggaggtaagtaaacgataaagttatcagaagtgatgaaagagaaaatgcttttatccttcgaactgtttccaccaaaaacagacaaaggtatggaaaatcttccgggcacaattgaacatttgtgcgaatacaaaccggaatatacttcctgtacttatggagctggtggaacaaatgttggtaagaacatggatgtgtgcaagatgattcaggctgccggaaccataccggtaacacattttacctgtatcggaaacacagcagacaattcttaaccaggctgctacaattaacatggcactttcacgtaatggctgtgtaatgcctcgtgaactttgcaaaattatttctaagaattggattttcccaaatctattcgacaaagaaccattcgatattgatgtagaaggcaagaaagctcgcttcaaagaagctggtatcgaatacacaatgaaacagattgatgaatatcgtgcacttggtgtaaatggcatccatctgtatgcactgaataagtggaaagacgtttctgagattattgacagatccggtcttcgcacattagtgcaagaaacaatattaaagaaatataggaggtgccctgtaaatggcacatgtaattgcgattgccggtaaaggcggtgttggtaaaacaacacttaccggattgattattcagtatctgggcaagaaaggcaaaggtccgattcttgcggtagatgcagatgcaaattcaaatttaaacgaggtccttggagtggaagtggaagaaacgcttggtgatatccgtgaggaagtggccagagcggaaatgtcaaaggataatccgattccaccaggagtgtcgaaagcagattatatggaatttaaatttgacgatgcattaattgaagatgatgattatgacttgctggtgatgggacgtacgcagggaaaaggatgttactgttttgttaacggacttctgcaggcgcagcttcagaggctggaaaaaaactatccttatatcatcgtggataatgaagccggcatggagcatatcagcagaggagttcttccgaatatggaggttgccattcttgtcagtgactgttcaagaagaggcgtacaggcagttggaagaattgcacagctgattaaagagtgtgacatgcacccgaagaaagttggtttaattatcaaccgagctccgaacggggtactgaatgaaggaacaaaagctgagattgaaaaacagggattaaccctgcttggcgttgttccgcaagacgaaacggtatatgaatttgattgtgacggaaccccgattgtagatttgccggaagactctccggtaagaaaagcaattgttgaaattattgacaatctggggctctaaaaaaactgggcctgccggaaaggggaggccctaagaaaaaaaagaggcgaaattcaaggaggatattcatgagtgaattcaaattaaccacagtagaagaattcgaagctgctactgagagactcctggagacaggggcaaaagttggcgcggatgcttggcagttccgtgtaaaaaatcagactccgcactgtaagtttggtgaagaaggtgtctgctgtcgtatctgttctatgggaccatgtcgtattacaaaaaaagcaccgagaggaatttgtggatgtgacgtacacggtatcgttggacgtaactatctgaaatttacagcaggtggttctgcaacacattccgaccatggtcgtgaaatctgtcataccttatatgaatcatcagctgatggatgttatcaggtaaaagatccggaaaaactgattcgcattgcaaaagaatggggtgtagagacagaaggaaaagatatctacgacttagcacatgaagttgcagaaatgggtctgtgggaatatggtaaaccgtttggaacacagagattcttaaagagagctccgcagtcacagcaggaattatgggaaaagaacgaacttgcaccaagagcaatcgaccgtgaagtttcatgttctttacatatggctcacatgggatgttcctctcttccggaggcattaatcaaacagtctatccgtgcaggtttatctgatggatggggcggttccatgatgggaacagaattctctgacgtactgtttggaactccaaagccaatcgatacagaagcaaaccttggtgttatggtagaagaaaacgtaaacatcgtagttcatggacatgacccgagtctttctgaaatggtttgtgaatatgcagactctccggaaatgattgcttatgcaaaagaaatgggagcaaagggaatcacagtatccggtgtatgttgtacatcaaatgaagtagctatgcgtcgtggtattccgatggcaggtaacttcttacagcaggaaaacgttgtacttacaggcgcttgtgaagcaatcgtagtagacgtacagtgtatcttcccggcactcggacctttaagtaaatgcttccacacaaaattcatcacaacatctccgattgcacagatgccggattctgaatttatccgctttgatgcaaaaacagctgatgaaaaagcaaaattaatcgttaaaacagcaattgaaaacttcaaaaacagaaaaccggaactggtacatattccacagttaaaacagaaagcaactgtaggatattctgtagaagcaatcatcaaatgcttagacggtgttgcaaacagtcaggttgatgaaatgggaacagtaaaacctctgttacagtgtgtaacatcaggtgttcttcgtggagcagttgcaatggttggatgtaataacccgagaatccgtcctgaccttgcacatatcgaattgatgaaaaaattaatcgcaaatgatatcgtaattattgcatccggatgttctgcacaggcagctgcaaaagccggtcttatggataaacgtgcaaaagatatctgtggtgatggattaaaacgtgtttgtgaactggcagatatccctccagtccttcacatgggttcctgtgtagatatcagccgtatgatgattcttgcttctgaactggctaaatgtgccggtacacatgtttcacagcttccagttgttggatgtgctccggaatggatgtctgaaaaagcagtttccatcggtaactatgtaattggtacaggtatcgatactttccttggtgttgacccttatgtttccggttccagcgaaattgctgaaatcttaacaaatggtacaagagagtgggtagaagcagcatttactgtggaaaaagatattgataaacttggagacgccatgatcgcacgtatcgaagaaaaacgtgcagcgctcggaatttaagagcagaaaaaacggctgtctgatttagaactggattagacagccggtataagaaaggtgaatgaaatgaaaatagcagtgacaggaaaaggcggtgtgggtaaaaccacatttgcagcgactttagcccggctgtacgcagacgaagggcgaaaagtccttgcagcagatgtggatccggacgcaaaccttggactggctttaggattcgacgaggaaactttagattcaattgttcccattacaaaaatgagaaagctggtagaagagagaaccggtgcaaatgaagtgaataagttttttaaaatcaatccgaaagtggacgatattccggatacttattcaaaagaggtaaatggagtaaaactgctggtactggggactgtggaaaccggcggtggcggatgtgtctgcccggagcatgtaatgcttcgcagaatcattaacaatttggtcattcatcgagatgatgtcgtaattatggatatggaagccggtctggaacacttaggccgtggaaccacccagtcaatggaccagtttattgttgtgattgaaccgggagccagaagtgtacagacttataagaatgtaaaacgtctggcagatgacctcggagtgaaacaggttcgtgttgttgcaaacaaagtaagaaatgtcgaagatgaagagtttgtaaaagctcatatcccggcagaggatctgttaggcttcattcactataacacagaagtgatagatgcggatcgccaggggaaatctccttacgatttcagcaatactgtaaaagaagagatcacaaaaattaaaaacataatcgacaaaggattatgagaaatcaggaggaagaaacattgacattatttgaaaccgtatttagcggaaatgatgctgtttatggattaaccgaaaatgcaattaatgcagcaattgagcagcatggtgcagacaaagcaatcagctttccagatactgcttacagcttaccttgctactatgcagtaacaggtgttaaagttgctactttaggagaattaaaagaagcgttaggtgtagtaaaaactcttatgacaagagaaatgaaaacacatgatgtatttatgtcaggtgttgctactgcattatgtgcagaatttattgaagtgttaaaatacatcgacggtgcaactccttatgaagcaccatgtgcaggacatgttccggatgcaatcatccgtgaacttggtgtaccgcttgtaacaggcgatatcccaggtgttgcagttatccttggttctgctcctacaacagaagaaggtgttgctttagtaaaaagctatcaggcacagggtatcttagttaccttagttggcggaatcattgaccaggttgaagaagctggaatgaaaacaggtgcaaacgtacgtgttatcccgcttggaaaagatgttacagcagttatccatgttgtatctatcgcattaagagcagctcttatctttggtaatgtgaaaccaggtgatgccgcttctctgatgacttatacaaaagaccgtgtaccggcatttgttaatgcatttgctcctctcgatgatgttatcgttgcatgtggtgcaggcgcaatcgctcttggattcccggttatcacaaatcaggaaggcgtttctgaagtaccgaagagcttaatctgccagccagatgttgaaaaattcaatgcaacatctttagaggcacgtgatattaaaattaaaattacaaacattgatattccggttgcttatgcatctgctttcgaaggtgaaattatccgtcgtggcgatatgcaggtagaatttgatggttcccgtgtagactgtgctgagttagtacatactgtagaagcttctgaaattgaagaccataagattacagttgtaggaccggaagttgacgaaatggaactgggaagcaaaaacagcattgcttatgtcgttaaagttgctggtagaagcatgcagccagattttgagccggttatcgaacgtaaattccataactatatcaactgtatcgaaggtgtatatcatacaggacagcgtgatatgcagcgtatccgtatcagcaaagatgcatttgcagctggattccgtatcaaacacatcggtgaagttttatacgcatccgttaaaaatgagtttgatgcagttgttgataaatgtgaagttgttatttacacagacccggctgaatgtacaagaattcgtcatgaagtggctattcctacattcaacaaacgtgatgaccgtctgaaaaacctgacggatgaatctgtagacgtatactacagctgtattctgtgtcaggcattctctccatctcacgtatgtgttgttactccggaacgtcttggtctgtgtggtgcggtttcatggctggatgcaaaagcaacaaatgaacttgatccgaacggaccttgtcaggtaatcacaaaagaaagatgtatcgatgagagaatcggtgaatacgaagatgttaatgaagcagttcgtaaactgtctcagggtgctcttgaagatgtatctctgtactctatcatggaaaaaccgatgacatcttgtggatgtttcgaatgtatctgtggtatcgagccattctcaaacggtgttgtaattgccaaccgtgaatatgcaggtatgactcctcttggtatgacattcccagagatggcttccatgacaggtggtggtgttcagacaccaggtttcatgggacatggtaaacactttatcggttccaagaagttcatgaaagcagaaggcggtatcgaaagaatcgtatggatgccaaaagaactgaaagaatttgttgcagacagactgaatgaaactgcaaaagaattatacggaattgaaaactttacagatatgattggtgatgaaacaatcgcaacagacccagaagaactggtaggattcttaacagaaaaaggacatccagctctttctatggagccaatgatgtaattagaggttcattccttagacgataatcataataagcggtgggggaagctgtggcctaacccgccgtttataaaaaatatacaaggaggctaataagaaatgccgtttaatcagaaaccacagaaattcaatgcaaatattaacacagttgaaatcggctgcggggacaaagcaatcaaattaggaggagaatgtacatatcctttctatacatttgatgcgccaatggaaaacgcaccaaaaattggtgtggaaatttccgaccttggacttgcagacgtacctggaatccaggaatattatgccggtgcaacaacaatcggtgaaatcgctaaaaaggcagaagcaatggaaggtgcggactttgtttgcttacgtcttgaaggtggagacccgaatggtgaaaacaaatccatcgaagaactgattgctgttgtaaaagaagttggcgaagcagttacctgtcctttagttgttgaaggatgtaaaaatgtcgaaaaagattctgaattactcccgaaagtagcagaagctcttcagggtaaaaatgttttaatcctttctgcaagagaagaaaactataaagctgtcggagcagcagcaggacttgcttataaccagaaagttggagcagaatccgctgtagatatcaaccttgcaaaacagttaaacgtagtattaacacagttaggtgtacaggcagaaaacgtagttatgaacgtaggttctgcagcagttggttatggtttcgaatatgtagtatctactatggaccgtatcaaaggtgcagctctttctcaggatgacaaacagttacagatgccaatcatcactcctgtagctgacgaggcttggaacgtaaaagaagcaatggcttcagaagcagatatgccggaatggggaccagcagaagacagaggaattagtatggaagtacagacagcagcagcagttctggcttctggttcagatgctatcatcctgaaacatcctaagtctgttgcaactatttccaaaatgattaaagaattaatgtaatcgtaagaaacaggaggataaaaaacaaatgggattatcaggtattcaaatctttaaaatgacaccaaaaaagaactgtaaggagtgcggatgccctacttgtatggctttctcaatgaaagttgctcagggtgctatggatatttcacagtgtccacacatgtccgaagatgctctggctcagttatcagaggctactgcaccgccaatgaaaacagttaaaatcggtgccggtgaaaatgaattctctttaggtggagaaactgttctgttcagacatgaaaaaacttatgtaagcaaaacaagatatgcagtatctttatgctcatgtatggacgacgccgcaatcgatgcaaagctggcagaaattccgaaagtggattatgaacgtatcggtgaaagaatgtttgctgaattagtatatgtaaactatgcagcagatacagacaaagacagatatgttgaaatcgtaaagaaagcagcagctttaaacagaacactgattctgggatgtaaagatgtagagcttgcaaaagcagctcttgaagtttgtaaagaagcaaaaccagtattaaacggtgctgatgcatcaaactatgctgagatgagcgcagttgctacagaagcaggtgttgtacttggcgtaactggaaaagacttaaatgaattatatgatactgttgcagctctggaaaaagcaggaaacaaaaacctgattctggatgttggaactgcttctatcaaagaagcttacggcaatgctgtacagattcgtcgtgcagcagtaaaagatcaggatagaacattcggatatccgactctggttaatgttgcagcacttgcacatggtgacagagtaatgcagcaggcactgttatctatgttcacaatgaaatacggttctatcgtagtagtagaaactctggattatgcagaggctcttccattatttggattaagacagaacgtatttacagacccacagaaaccaatgaaagtagaaccaggtatctacgcactcaacggagcagacgaaaactccttatgtcttacaactgtagacttcgctcttacatacttcgttgtttccggtgagttagagcgttctggtgtaccttgcaacctgattatcagtgatgcaggtggactttccgttctgacagcatgggcagcaggaaaactttcttctacatctgtagcaaaatacattcaggaaaatgtagaagataaagtaaaatgcagaaaactggttattccgggtaaagttgctgtattaaagggtgaccttgaagcaaaattaccaggatgggaaattattgttgcacctcttgaggctgtacagttagttaaattcttaaaagacctgactgcataatgattttttagaatcacctttccggggagatctgttctccctggaattgtaagaataacatgaaaaaaaggagaacaaagttatggcaaaatttgttacaatcggtgaaagactttccaccacagctccagcagtaaacaaagcatttttagaaagagatgcagaaccaatcttaaaaagagcaaaacagcagcttgatgcaggtgctgtataccttgatgttaacatcggacctgcagaaggatatggtccggaactgatgaaatgggctgttcagctccttcaggaaaactttgacaacgttccgcttgctctggatacttctaacaaagaagcaatcgaagcaggtatctctgtatacaaccgtgcaaaaggaaaaccaatcgtaaactccgctgatgcagcaggaagaatcgaatacgttgaccttgcagcagcaaacgatgcaatcgttatcgcactttgcaacggtgaaggaatcgcaagagacaatgacgaacgtatgggatatttacagacactgctcgaaagaggtttagagcatggaatggaagaaacagatctgtggtttgacccgctgttcctggttgtaaaaggtatgcaggacaaacagatggaagttcttgaattcatcaaaatgatttctgacatgggactgaattctacaggtggtctgtccaataactcaaacggtatgccaaaacacattcgtccaatcatggattctgctttagtagctatgtgtatgatgaacggtctgacatccgcaattgttaacccgaatgaccttcgtctgatggaaacaatcaaatcttgtgatgtatttaaaaacaacacattatatgcagattcttatctggaactgtaatctacagaagttaaaataggtaagaaaatctgggcagtaattaacgagagaagcagatgttatgtctgcttctctccgattaaaaagaatcagaaaggcgaattcctatgtttaaagtgacttttaagtttgaaggggcggaagatgttatcacttatgcccaggaaggagaaaaccttctcgaaatcgcaagaaagagcaatgtagcaattgatgcaccttgttctggaaatgcatcctgtggaaaatgtcgagtaaaattaatcggaggagagattgagtctccgaaaacccgtcatatcacagatgaagaatatgcagaaggctggagactggcctgcgtaagcaaagtaaccggagatgtagaagtacaggtaccggatattgcatctgcctacagaagccgtatgaaagttgctgatttaagctctaaagaagaagttgcaatttttgaaaaagcaaaatcggatgtagaatcagcaggaatttctttgacaaacagcctggatgttattaatgttaaaatgaatgtgccgactctggatgacacgatgccggataatgaacgtctggttcgtgcaatcaaaaaacagacaggaattaaaaaagtacggatgccatattcagtactgcgtaaaatttcttatgttttcagagaaagcaattttgaagtacagtgtgtcattagaagcacagaaaatgatatttttatttatgatgtctataaaaaagatgaaaaagtggtaatcggaggattggcaattgatatcggaacaacaaccgtttctgctttattaattgatatgaagtctggagaaattcttggaaaggcttcttccggaaatggacagattcgatatggagcagatgttatcaatcgtattattgaatctatgaaaccaggtggaagtgagaaacttcaaaaagcggtaattcaggagacaatcaatccaatgattcagcagatgtgccgtgcaagtggatttaaaccggaacatatctatcgtttaagcattgcttctaatacaacaatgaatcatctgcttacaggaatgaacggagatccgattcgtatggaaccgtatattcctactttttataaaacaaattctttatttgcctcagatattggaattcaggtaaatccagatgcccatattattatggctccgaatatcggaagctatgtaggtggagatattacagcaggtactttagtcagtatgctgtggaatcgtccggaattttcattatttattgacttaggtacaaatggagaattggtatttggtaattctgattttatgatgagctgtgcatgttccgcaggtcctgcctttgagggtggagatatcagctgtggtatgcgtgcaaccgatggtgcaattgaagcatgtacaatcgacaaagaaaccatggagcctacttatagtattattggagaagaagggcagaagccggttggtctttgtggctcgggtattattgatgtaatcagcgaattattccgtacaggtattattaatccgaaaggaaaatttgtgcgggagggaaaacgtgtccgtcatgaccattttggcatgggaagttatgtgctggcttttgaagaagaagctggttcagtaaaagacgtggaaattaacgaagtagatattgataattttattcgtgcgaaaggtgcgattttctcggctgttcgtacgatgttggcatctttggatttcgatgtttccatgattgatgatgtatatgtagccggtggaatcggtagtggtatcaatatgaaaaatgcggtgcatattggtatgttccctgatatccctctggaaaaattccattatattggaaactcttctttatccggggcatatacgatgttgttatcaagagacgcagagcgaaaatgttatgagttagcgtccaatatgacctatctcgaattatcgactgtgccaagctacatggatgaatttgtagcatgttgtttcattccgcatacggatagaactctgtttccatcggtgacagaagcttaggaggaaaaaatggactttgattatgcaaaagacagcaaggaacagcgtccttatgaatattatctgaaaacctatcaggaaatagacccaaaagaaatcagtgaaagaactggatttttctatgacgaagagaaaaaagtgtttactgtagtgtttatgggtagcacttatgaaatttcgtttccggattataagatttctcataaagaagatgaaaaaggggtatatccgttagaagaggcgatgaatgccaagatttttatggttcgttatctgtctgaaaaagcaaaagctccttcttccggaaagtttttaacttatcgggaggtaccgtggggagaagtttattttagacaatttcagggacgatgcctgatgcgtctggcatttagctatggaaataaacttgaggcatttaaaaaggtaatgactgcaatgggagcaaaaccgttagagcagggagactgtgcctttgagcttgagtttatggaaggattcttcattcgactgattctgtgggaaggggacgatgaatttccaccatcttcacagattttattctcagataattttgcagtaacctttgccgcagaagatttagcggtggcaggagatatctgcattaacatgatgaaagcagtcgaaagaaaactgtcttaatattgaaaataatctctcgaatgttaaatttgggaatcataaataaattgaacataaaaataagcactttgtgcttaaatataaagaaaagagaggaataacattatgggattttcaaccgtaccatgtaatgaatttgtggaagtactggcatcaaaagcacctgtacctggcggtggcggagcatctgcattggttggtgctgttggtactgcacttggaaatatggtaggaagccttaccgttggcaagaaaaaatatgcagaagtagaagatgaaatgtgggaattaaagaaaaaatgtgatgaacttcagaaagatttcctgcgtttaatcgaaagagatgcagaagtgtttgagccgctttccaaagcttatggtatgcctagagagacagaggaagaaaaagcagaaaaagcaagagtaatggaaatcgtattaaaggatgcctgctctgtaccgatggaaattatggaaaaatgctgtgaagcaatcgaagtgattgttgaatttgcagcaaaaggttctactctggcaatcagtgatgcaggtgtaggagctgcattctgtaaagccgcgttaaaaggtgcaagtttaaacgtctatatcaatactaagtccatgaaagacagagagtatgcggaagaactgaacaaaaaagcggatgcaatgctggaaaaatatacaaaaattgcagatgaaacatttgacagtgtactttccagactgaaataagagaaaaacaattgcggaggtttaagaaatggcaaagagattactgggtaaagaagtaacagcagcattaaacgaaagaattaaagcagatgcggaagcactgaaagcaaaaggagtaaatccaactctgtgtattattcgtgtcggtgaaaatgaaagtgatatttcttacgaaagaggagcaacaaaacgttgtgaaacattaggagtagcatgtgaaaaaatccttcttccggaagatgtaagtcaggaagaactgcttgcaacaatcgataaagtaaataaaaatgaccagattcacggagttttattattccgtccgcttccaaaacatctggatcagtctgtaattgagaatgcacttgaccctgcaaaagacgtggactgtatgacagatggttctatgtctggcgtattcacaggcaaaaacgttggtttccctccatgtacaccacaggcatgtatggaaatcttagatcattatggaattgactgtacaggtaaaaaggcagttgttgttggaagaagtcttgttgttggtaaaccggcagcaatgatgctgattaagaaaaatgcaactgttacagtgtgtcacacaagaacagtagatatgccatctgtagtaagagaagcagacatcgtaatcgtagcagcaggacgtgcgggtgttgtagatgacacttatttaagagcaggtcaggttgtaatcgatgtaggaatcaatgtaaatgcagaaggaaagctttgtggagacgttgattttgaaaaagcagaaccaatcgtagaagcaattactccggtaccaggcggtgttggaagtgtaacaacatctgttttagttggacatgttgtagaagctgcaaaacgtaaatttgcttaaattacatagttgttattcttaggaatagacaggctggaattcaattgcaagttccagtctgttttttgttctaataatgaaaaaacgggcatatactttagcagtataataagggggaatctatatggatacctataatatctataaagatatacaagcccgcacaaggggagaaatttatattggtgtggtaggaccggtacggacaggaaaatctacctttgtaagaagatttatggaattggcagcgcttcccaatatggaggaaaaccagcaaaaagaggtaagagaccagcttccgcttagcggttctggaaagttaattacaaccgtagaacccaaatttatcccaaaagaagctgcaaagatacaaatagcagagggattggaagcaaagattcgtttaattgattgtgttggatatatggtgcctgaggcggcaggaaatatagaagaaggcaaagaacgaatggtaaaaactccctggtatgcacaggaaattccatttcatcaggcagcagagactggaaccaaaaaagtcatagaagaacattccaatattggtctggtggtgacttgtgacggctcatttggggaaattccaagaaaaaattacatagaaagtgaagaaaaaacggtggctcagttaaaaagagctggaaagccatttttgattcttttaaactctcagaagccatacaaagaagaaacactggaattagcggaagaattaaaaaagaaatatcaggctggtgtgattagtgtaaactgtgagcagttgagaaatgatgatgtgacgagaatccttgagaaagtgttgtatgaatttccgattgttcagatggaattttatattcccaaatgggtagaaatgttatcttcggagcattatttaaaagaagaactgatttcgtgtgtacagcagatgatgcaaacgatgcattacataaaagatgtgacaaaagaccggctggagtttgaaagccagtatgtaaaaggattattcttagaaacattagatttatcaagtggaaaaataaaaatccgtattgatatggatgacagctggtattatgctattttgagtgaaatgacaggggttgatatttcagatgaatatgaactgattcatatgatgcaggaactttctaagatgagaggggaatacttaaaagtaaaagatgcaatagagtccgttcaggcgaaaggatatggtgtggtaactccggataagacagaaattcgtttggaagaaccaattatcataaaacaaggaaataaatatggagtaaagattaaatctatcagtccttccattcatttgattcgtgccaatatagaaacagagattgcgccgattgtaggaagtgaagaacaggcaaaagatttgattgcctatattaaatccaacaattccggagaagagagtatctggcagaccaatatttttggcaagtcaattggacaattggtagaagatggaattcatcggaaattaatacagattagtgatgaaagtcaggtgaagttacaggataccatgcagaaaattgtaaatgacagcaagggcggtctggtctgcattattatctaaggagtctgtattattgattgacttttgagccatgaaattatataattacagggagaaagaaagtagaaaaagcagagtcggtgcagatgtggaaacaggtgaaatccctgtgcaagtccgttactgtacagccagatacacatgtgccggagaaaaagaatatctgcggcaaccggatgttttgaaagaataaaatgtgccgttgtcaggaaatctgacagcggttttttgattcttatgaaacttcattttaaccaaatcaaggaagtcccctgcttcaattgcaaaaagcaataaacaggggtggggacttgcttgtatcaggagggggcaagccccttctgataagctgcgtagcagctatttggttatgagcaagtagcgaaagcggattgcgaatatccgcttgactaatcaaaaactgccctgctttcagaaactttagagaagagaaaaatacagcgagagaaaaggacagagatggcacataaaacaggtctggaagaatattacattattaaaaataataaaaaaatgcgttatggttatacgactggttccagtgcaacggcagcagcaaaagcggcagttaaaatgctgttgtcaaaagaagtagtgaacacggtatcgcttatgacgccaaaagggattttattaaacctggagattcttcatatcaacatcgaagaaaaccaggtttcttgtgctgtaaaaaaagatggtggggatgaccctgatatgacaaatggtctggaaatctttgcattagtcaaaaaaacgaagcaggcgggagtctttattgacggtggagaaggagttggtcgaattactaagaacggactggaacagccgataggaaatgcggcaatcaaccaggttccaagacgcatgattacaaaagaggtggaagagatctgttctcagtatgaatatgaaggcgggatttctgtcttgatttttgtaccgaaaggagaagagattgcaaagaaaacctttaatccaaaacttggaattgtaggtggaatttcaatcttagggacttctggaattgtagagccgatgagtgaggctgccttgattagaagtattggagtcgagatgcgtcagagaattgcaaatggttctgagtatctgttagttacaccgggaaattatggaagttcgtatctaaaagaggaactgaaattaccgcttgcggaatctttaaaatgcagtaattatgttggcgaaaccgtagatatggcagtcgatatgggagcaaaaggaattttgtttgtggcacatcttggaaagtttgtaaaggttgcaggagggattatgaatacccattcccgttcggcaaatgcaagggcagaactgatggcagcaaacgcaattcgtgcaggtgcttcattagagactgcaaagcagattcttgatactgtcacgacagatgaggccgtgcagattgcgaaagaagccggaattttaaaggggttgatgcaggaaattaccggtcggattgaagaaagtctcaaccatcgttcttatggaagactggtttgtggagctgtaatcttttccaatgagcatggctatcttggacagacagagcatgcagatatgttgatgagagaaattagaaaaaagacacagaaagaggagaaaaaatgacaggaaaattatatggacttggagttggaccgggagaccctgaactgttgacagtaaaagcacttcgattggtaaaagaaagtgatgtagtagcggttccgggagcagttgcagaggaaagtgttgcctataaaattgtaaaaggggtatatcaggaattagatgagaaaaatctcattccaatcccaatgccaatgacaaaagacccggctgtattagaagaaaatcaccaaaaagcagcagataccatagaagaacttttaaagcagggaaaacaggttgcatttttaactttgggagacccgactgtgtattctacttatttgtatgtacataaacgaattttagagcgtggttatgaagtagaaattgtaagtggaattccgtctttttgtgcggtagcagcaactttaaatatgggactggtagaaatggcagaaccgcttcatgtgattcctgcaacgtacaatgcggataccatggatgaggtattaaaacttccggggacaaaagttttgatgaaaaccggaaggaaaatgaaagcagtcagagagagtattttaagaagtggtcaggatgcagttatgattgaggattgtggcatgccgagtgaaaagatttataaaagtgccgaagaaataccggaacagtccggatattattcattaattattgtgaaggagaaaaaataagatgatacattttgtaggagcaggtagtggagcaccggatttaattacaatccgaggaaagaagtttttagaggaagcggatgtgattatctatgcaggttcattggttaatccacagcttttagactatgcaaaagaaggttgtcagatttataacagtgccaagatgaccttagaagaagtactcgatgtgatgagagaggcagaaaaagcagaaaaaatgacggtacgtctgcatacaggagacccatgtctgtatggagcaattcgtgagcagatggatgtacttgatgaagaaggggtttcttatgattattgtccaggtgtcagctctttttgtggggcagcatcagcacttaatttagagtatacacttcctgaagtatcccagagtgtgattattacaaggatggcaggtagaactccggtaccggaaaaagaaagtattgagtcatttgcggcacatcaggctacaatggttgtattcttaagtacgggtctgttagaggaactttccaaacgtttaatcgagggtggatattccaaggatacaccggcagcaattgtatataaagcgacctgggaagatgagaaatcttttgtctgtacggttggtacattggcacagactgcaaaagaaaatcagattaccaaaacggctctgatgattatcggagaggcagttgcacattcaaattatgaacggtcaaaattatatgacccgggatttacaacagagttcaggaaaggaacggatgcagaatgaagatatcaattataagtttcagcagaagcggatatcgcattggagaaatgctcagttggtttttaggcgaaggcgggcatgaagtagaggcatttacaaagagtaaatacacaaaaaagatattggatgagtcacaggtagaggcagatgacaaagcatttcgtaatgtaaaagaatttgcaaaaccgattgattcttctcttcgagactggacaggacgccgctttgcacaaagcgatgcgattatctttatcggagcttgtgggattgcggtacgaagcattgctccatttgtgagcagtaaaaagacagaccctgcagtagtggttattgatgagcagggaaaatttgcaatttctttgttatccggtcatattggtggggcaaatgaactgacagaggaaatcagcaatcttctgcatgcaacaccggttattacaactgcaacagatattaacaataaatttgcagtggatgtatttgcaaagacaaacggatgctatatttctgatatgacaatggcaaaagaaatttcagcagcacttgtaaatggaaatagtgtaggatttgccagtgattttccatgggttggagagattccgaaagagttacagctgttggatgaagaggacgagacaaaagaaaaaccggagatgggaatttatgtgacaaatagttatctgaaacatccatttgtacataccctttatttggttccgaagattattactcttggagtaggctgtaaaaaagatacaccggcagacactgtggaaaaagtagttagaaaagcgtgcgatgaactcttaattccatctgtttcgatggagctggtagccagtattgatttaaagaaagaagaacagggaatcttagaatactgtaaagagagaaatcttccgtttgaaacttacagtgcagaacagttaaaagaagtagaaggaagttttgcagaatcgaaattcgtagaggagacaacgggtgtagacaatgtctgcgagcgaagtgcaattcttggaagtagtaaacatggagaaaaaagtaatctgattcttagaaaatatgcagaggatggcgtgacagcagcacttgccagacggaaatggagcgtacagttttgaaaaaattatatgtagttggcatcggacctggtgcttatgagaaaatgacaattgaggcagcagaggctttaaaaaacagtgatgtaattatcggatataccgtatatgtagacctggtaaaagaacattttgccggaaaagaatttttgacaacaccgatgaaaaaagaggtggagcgctgtaagatggcatttgaagaagccatgaaaggaaagacggtatccatgatttgcagcggggatgccggtgtttatggaatggcaggcttaatgtatgaagtaggaatgaattatccggaagtggaactttctgttattgcaggtgtaaccgcagcaacaggcggagcagcggtattaggagctccactgattcatgacttctgcctgattagtttaagtgacctgctgaccccatgggagaaaatcgagaccagacttttagatgcagcgcacggagattttgtgatttgtctgtataatccgtccagtaagaaacgccatgattatctgcagaaagcctgtgatttaatgttaaaatataaaagtgaagaaacagtctgcggaattgttggaaacattggaagagatggagaaagtgagaaggttatgacgttaaaagaactgcgtgatacacaggtcgatatgtttacaacggtatttattggaaattctcagacaaagaatatcaatggaaaaatggtgacaccaaggggctataaaaatgtgtaaggtgcttgtatttgcagggacaacagaaggcagaaaaatttcagaatttttagaaaaacaaaaaatccagacacatgtctgtgtagcaaccgagtatggagagacacttctgccaaagagcagttatctaagcgtctctcatgagaggttggatgaaactgcaatgaaagaggcgatgcaaaatatgcatccgtctcttgtcatcgattcaacccatccttatgctgcggaagtaacaaaaaacattcgcaaggcatgtgaggagacaaaaacggaatatgtacgtcttttacgtgccggaagtacagaggatacaaagaatgattccagtgtatatgtagattccgtggatgaggctgtagaatatttaggtacaacaacaggaaatgttttagttaccacgggaagcaaggaaattcataagtatacaaagattgaaaattataaagaacgaatttttgcgcgtgtactttctctttctaatgttgccgaacactgtaaaagtcttggatttgagggacgaaatctgatttgcatgcagggaccgttttctatggaattaaatgaggcaatgcttcgacagtttgattgtcgttatctggtaacgaaaatgtccggagtgacaggcgggtatgaggagaagctggaagcggcaaagcgggcaggctgtatctgtgtgattgtaggtcgaccattaaaagaagagggacttggattaatcgaatgtaaagcattattatgccagcgttttggattaaaacaaaaccagaaagtctctttggttggaatcggaatgggaaatccggatacctgtacaatagaagcaatcaaagcaatcaaagaggcagaacttttaattggagcaaaacggatggtcgaatctgtgttgcactcggaacaggatgtgttgattgaatataacagtgaaaaaataaaagtatatctggataagcatccggaatacgaaaaaatcgcggtattgctttctggagatgtcggattttacagtggtgcaaagaaactgcaggaaacattaaaagagcgcgaggtaaggcagataagcggactttcgtcaccgatttattttatggcgaaaatcggacgctcctgggatgatgcggttatcaccagtgcacatgggaaagaagaaaatctggtggaactgataaaaacacatcagaaagtggtttcgattttaggaacaaaagatgcggtggcaaatcttgcaaagacgttgacaaattatggaatgggaaaggtgattttttttgtaggagaacgtctttcttatccagacgaagcaattgtgcagggaagtgcagattccttctgtgattatgagggcgatgccttaagtgtgatttatatagaaaataaagaggcggaaggcttaccatccacacatggcgtaaaagatagtgcgtttttaagagataaagtgccaatgaccaaagaagaagtgcgctgtgtttctttggcgaaacttggcttaagggaagattctgtctgttatgatgtgggagcgggtacaggttctgtgtctgtcgaaatggcacttcgcacgccaaaaggcagggtttatgcaattgaaaagaaagaaacggcagtggagctgttaaaaaagaacaaacaaaaatttatgacggataatctctctgtaatagaaggagtggcaccggaagcattagaagcacttgaagtaccaacacatgcttttatcggaggctcttctggaaatatggaatctattttaagattactgcttgaaaaaaatccgaagattcgagttgtaattaactgtattgcacttgaaagtgtagcagaagccaatcgttgcatgaaagtactgccatttgaagacgtagaaattatacagttaagtgtaagccgtgcaaaaaaaatcggaagctatcagatgatgatgggagaaaatccgattacgattttttctgcaacaggaaagaaagaagaaaaagaggaggaatagccgttatgaagatacctcgttttttgatttgtgcaggggcaagtggaagtggcaaaaccttgattacctgtggactgcttcaggcacttataaatagagataagaaagtagcttcttttaagtgtggaccggattatattgacccgatgtttcataccaaggtaatcggaactcattcgagaaatctggattctttttttgtgaatgagcctgttttaaactatctgctttccaaaaactgcaaaggtatggacattgcagtgatggaaggtgtgatgggctattatgacggtgcaggagggattacttccaaagccagtgcttatgaagtggcctctatgacaaagacaccggctgttttgattgtaaactgtaagggaatgagtgtttctattgtgccttatattaagggatttttggaatataaagaaaacagtcagataaaaggcgtaatattaaatcagatgcctgcaatgctctatccgagagtaaagcagttaattgaatcagagttagaaattcaggtacttggatatgtgccgaaagtagaggattgtgtgattgaaagcaggcacttaggactaattttaccaaatgagattgcagattttaaggaacggcttgcaaagcttgctaaggtgttagaagaaaccattgacatggaaaaactgcttttgcttgcagagaatgcaccggatttagaagaagaaattccatgggacaaagacagcgagtatgcgtttcaattagaacagccggttcggattggcattgcaagagatgaggcgttttgttttatttatgaggataatctgcagttattacgaaatatgggtgcagagctggtagagttttcaccgcttcatgatgaaaaacttccaaaaaacctgtatggattgattttttatggaggttatccggaactctttgcaaagcagttagaagaaaatcattcgatgcgggaagcgattaaaaaggcttatgaaaatggaatgcctgtgattgcagaatgtggcggttttatgtatctgcatgagacgatggaagatatggaggcaaaaccgcataaaggagtcggcattataaaaggagaatcctatcggacttcaaagcttggtagatttggctatatttcgcttaaatcaaagacaaatcgagtgttggaagaaaattgtgatgagattccagcacatgaatttcactattttgattccacttcgtgcggaagtgattttgtggcgaagaaaccatttagcagcagaagctgggagtgtattcatttagaaaaccatcttctggcaggatttcctcatttttattattacggaaatcctgctgtggcaaagggaattttaaagagttgtcagatgtataaagataagacgatatgaaaggattctgagactacataagaaaaggagtatgaaaatgaaactggaagaagcgctgaaaaaaatagaaccattagatgaaacagcgatggatgtatgcaagaaaagatgggatgcgattgcacatccactgcacagtcttggaaaattagaagatatgctggtacagatttcagggattaccggcagtgcggatattgatgtaagaaaaaaggcactcgttccgatgtgtgcagataatggtgtggtagaagaaggtgtcacacagaccggacaggagataacggcgcttgtctgtgaaaattttcttcagacgaaagcagtatcaagtattatgtgtaagagtgtaggtgcggaaatttttccagttgatgtgggagtggcaagtaacgtcagtattttgaaccgtaaaattgcttatggaacaaaaaatatggtaaaagaacctgctatgacaaaagaacaggcagttcaggcaatcgaaaccggaattgaaatggtggaaacgttaaaagcaaaaggctatggaattattgcaactggagagatgggaattggaaatacaacgacgagcagcgcagttgcttcggttattttaaaacgtccggtagaagaaatgacgggaagaggagcagggctttcttctgagggattgaatcgtaaaattacggcaatcaaaaaagcggttgcccttcataagccagatccagaagatggaattgatgtggtttccaaagtaggtggttttgatattgcaggaattgcaggtctttttattggcggtgcagtatataaagttccgattgtaattgatggagtaatttccgcagtaggagctttggttgctgtcaccatctgtccgcagtgtaaagattatatgctggcaagtcatgtgtcaaaagaaccggcaggacagttattactggaaagtcttggaaaagaagcgccgcttcactgtgatatgtgtctgggagaaggaacgggagcacttaacttatatccattattagatacagcggtagcggtttattatggaatgagtgattttagtggaattggcatggaagcttatgttccgcttcagtaataaaagagataataagagagatatgaataataggtgagaaattagccattgagagatggaatgaaaagaggataaaaagatgattacacttgtaaccggaggcagtggaagtggaaaatctgcttatgcggaagaggtattgactggttttggagactttccacgaatttatattgccacaatgtatccctttgatgaagagagtaaaaagagaattgagcgtcaccgaaagatgcgggcagagaaaaattttaatacaatagaatgttacaccggtcttcggaacttagaacttcccgaaggctgctgtgtgcttcttgagtgcatgtctaatctggtagcgaatgaaatgtttcaggaagatggggcaaaggatgacacagtgccagagattttagaaggaatttcagaaatcgaaaaacaggcaaaagaactggtcattgtaacaaatgagattttttcagatggaattgactatgatgaagaaacaaaacgatatcagagttatcttggaaaaatcaatcaggagctggcaaagcgtgcaaaagcggtggcagaagtggtttatggaataccagttgagagaaagaatcaaaaaggagttatccgggagaagaaaaatggcacagaaaaatgaaaagaaaacaacaacggcaggtcagcttgcaaacagttttaaaattgcattttctatgtattctaaaattccaatgccgcaaagtgagtggagtaaagaaaatatgcgttatgtgatgtgttttcttccgttaatcggagcggtcattggatttttaagctggatttggggaacatatgcaggactgtttgtacacagccataatttttatacagtcatccttgttttgattccggtgttggtaagtggagggattcatttagatggactgcttgatacatcagatgcattaaattcttatcagccaagagaaaaaaaattagagattttaaaagattccaatgcaggagcatttgcaattattgtgggaatctgctatttccttttatattttggtgtttacagtgaaatgacagtaagaagccttccggttatctgcattggctttgtcttatcaagagcgctgggagcattgtctattgcaacatttccaatggcgaagaatacgggacttgcagcaacattttctgacggagcacagaaaaatacagtcaaagtggtttctgttatcgtggcagtactttcaatccttttcatgattgcagtcagaccgttgattgggctttgtgtattggttggggcaggctgtgagtatctttattattataaaatgtccatgaaacaatttggtggaattaccggagacctggcagggtttcatatacagatatgtgagctggtgattgccttatccgcagtaattggacaaatcataggaggatgagagatgagactggtaataggcggagcttttcagggaaagaaagcttatgtggcagaaaaatatcagcttccaaatgaaaaaatgacagacggaagtgcagcgtcttacgaagaaatttttgacactccgtgcctgtatcattttcatgaatgggtaaaagaaaggttaaaagaagggaaaaagttagagagtctggaagaagagctgatagataaaaatccagatattattctgatttccaacgaactgggatatggagttgttccgattgacaaatttgacagagaatatcgggaaacaaccggaagagtctgtaccagactggcaaagaagagtaaaagtgtagtgcggattatctgtggaatggagtgtgtattaaaagatgagtaaattttatctgattcgccattccattacaaagggaaatctggaaaaacgctatattggagcaaaaacagatgaaccactttgtaaggcaggatatgaactgctcaaagaaaagcattatccgaaggtagaaaaagtcattgcaagcccgatgaagcgctgcatcgaaacggcacaattattgtttccggatacacaaatacagatagaggaaagtttaagagaatgtgactttggtgagtttgagaacaaaaattatcaggaattaagtcagagtaaagcgtatcaggcatggattgacagcaatggaacacttccatttccgaatggagagagtcaggaaagttttagaaaacgaagcacaaccggctttaagcgttgtattgagcaatgtttaaaagaagaaataaacgaagcagcatttgttgtgcatggaggcacaattatgagtgttttaagttcccttgcgacaaaagaaaaagattatttttgctggcaagtcaaaaatgcagagggatttttagttgaagttaccaaagaagaatgggaaaatacccgtaaagtaaccgtaatcaaagaaataaacgggaaggaataagaaaatgataaagtggacagcggtaatgcttgtgattggatttttactggatttattgattggagacccgagatggctgtatcacccggtaagaatcattggaaacagtatcactttttttgaaaagtggctgcgtaagtgttttccaaaaaccccgtcaggagaaaaaatggcgggatgtgttttagtgattctgatttgtctggaaagcagtctggctccatttgttttgttatttcttgcatttaaaattcataccgcagtcggtatagtgcttggttcttttttttgttatcagatgcttgcgacaaagtctttaaaggatgagagcatgcgtgtctatgagaaactagaacatggaacaatcgaagaagcaagagtggcagtttcaatgattgttggacgtgatacacagaatctgaacaaagagggagtcacaaaggcaaccgtagaaactgttgcggaaaatacttctgatggaattattgcaccgattttttatatggcagttggtggtccggttttgatgtatttatataagggaatcaacacgatggattccatggttgcctataaaaatgacaagtatctgcattttggctggtgtgcggcaaaattagatgatatcgcaaattttattccggcaagaatttctgcttttttgatgatcttagcagcttttgtatgcagattagactggaaaaatgcatggcgtatttttaaaagagaccggtataatcatgccagtccaaattctgcacagactgaggcagtaatggcaggggcattagatgtggcacttgcgggaaatgcttattattttggaaaattatatgaaaagaaaacgattggagatgcgattcgcaaaattaagccggatgatattatacttgcaaaccgcatgctttatgtggcagcaacaatcagtgtgattttatttgctgtcattcggattcttttacagctgatatagaaaatgtatgccggaatttcaggaatgtttgattgaaagcgatctataaaaaaggctttgagcgtatatatattgtagtagaatggagaaaagaaaatgagttatcatacacatggaggagatgtctatcgaaataaaaatgtgattgacttttctgcgaactgtaatccatttggaactccaaagtccgtaaaagaagcagccgtacaggcaatggaagaagtctttcattatccggatacggattgtcaggaattaagagaagcaattggagtttatgaagaggttcgaccggagtggattatctgtggaaatggagcagcggatttaatttatcgtctggtgttgggtacaaaaccaaaacaggcagtgctgtttgcaccgacttttgcagaatacgaacaggcattagaaatcgtgaattgcgaagtgaaacattatgaattaaaagaagaaaacggtttttgcgtggaagaaacccttttggactggattacagaaaagacagatatcgtatttttgtgtaatccgaataatccaaccggagtactcttagaaagaaaatttatcttagaggttttaaaacgctgtaaagaaaaaaatagtctgtttgttttagatgagtgttttgttgattttgtggaagaacctgaaaatcatacaataaaagatatgctgaaagaatatccgaatctgtttcttttaaaagcctttacaaagcgttatgcaatggcaggagtcagactgggatatggtttgagcagtaatcaaaggttgttggaaaaaatacagcattgtgggcagccgtgggcagtttctaccgtggcacaaaaagcagggattgcagcattaaaagaagaagagtatgtaaagagaagtatggcttatgtgcatgcacagagaaagaaactgataaaaaatttaacgcttcttggttataaaacctttgattcaaaggcaaattatattttctttcaaggggaagaaggcttgtatgaaaaatgtctggaaaaaggaattttaatccgggactgcagtaactattatggattaaaaaaaggatattatcgtgtggcggtaaagcttcaagaagaaaatgaaaaactgttggaagttttaaaagcatgcagaaaggatggagaaaagtggcaaaagcgattatgatacaggggacaatgtcaaatgcaggaaaaagccttttgacagcggggttatgccgtatttttaaacaggatggatataaagttgctccatttaagtctcaaaatatggcattgaattcttttattacagaagagggtctcgaaatgggacgtgcccaggtcatacaggcagaagcggcaggaatcaaaccgtctgcgctgatgaatccgattttattaaaaccaaccaataacatgggaagtcaggtcattgtaaacggagaagtgcttggaaatatgagtgcgaaagattattatgcatttaagaaaaatcttcgtccgaaaattttagaggcctatgaaaaactggcatccgaatatgatatcattgtgattgaaggagcaggaagtccggcagaaatcaatttaaaacaggaagattttgtcaatatgggaatggcaaagatggcaaaagcaccggtgctcttagttggagatattgacaggggcggagtatttgcacagcttgtcggaacagtgatgctgcttgatgaagatgagcaggatatggtaaaaggtctgattatcaataaattcagaggggataaaagtattttggaccctggagtggaaatgttagaagaacggactaaaattccggtggtcggagttgcaccgtatttaaatgtagatattgaggatgaggatagtctggcagaacgcgtaaaaggaaatcgagaagtggatttaattgatattgcagttatccgccttccgaggatttcaaactttacggattttaatgcacttgaagtgattcccggagtttcagtacgttatgtcagaacggtaaaagaactcaaaaatccagatatgattattcttccgggttctaaaaatacaatggaagaccttttatggatgcgccagaatggattagaagctgcgattttaaagaaagcaggggaagataagattatttttggcgtttgtggcggctatcagatgttaggagaaactctttttgacccggatggtgtcgaatccggtggaaagataaagggaatgggattgcttccgatggataccgtctttaaaggcgcaaagaccagaactcgcgtagaaggtcgatttttggaagtgaccggtgcactttctgctttaagtcagattgaattagaaggttatgaaattcatatgggagaatgtaccagaaaagagaatgcaaaaccgcttgtcacaataacagataaagtaaatggggattccaaagcagacggaacgtataaagacaatgtgtatggctcttacgtgcatggaatctttgacaaagaagaagtggcagaagcagttgtaacttcaattggaaagaaaaagggactcgatgtcagtgaaatgacaggggtagattttgccgaatacaaagaaaaacagtatgacctgcttgcggatggtttaagagaatacctcgacatggaaaaaatttacaagatattagaagaagggatttaattgtgaagacaaagctggagaatgtaaaaccaaaagaaattgaaacaagaagttttgaaattattaccgaagaattaggggataaaaaattacagccgggtacagagttgattgtaaaacgttgtattcatacaagtgcggattttgattatgcggataatctgtatttttccaaagatgcggttcctaaggcaattgaggcgattaaacacggggcatgcattgtaaccgatacgcagatggtaaaagccggaattaataaaaaagcacttgccaaatttggcggtgaggtgtattgttttatgtcggatgaggatgtcgcaaaaaatgcaaaatcagcaggaagcacaagagcagcagcaagcatggagaaagcggcaaaacttggaaaaccggtaatttttgcaattgggaatgcaccgactgcgctggtgcgtctgtatgagttaattcaggaaaaacagattcagccgtatttgattattggtgtaccggttggatttgtaaatgttgtacagtcaaaagagatgattatggaaacagatgttccttgtattgtagcaaagggaagaaaaggtggaagcaatattgcagcctgcatctgcaatgcattgctttatatgattgacaatgaaagagattactggaaataaaatttgaacgcagataagcggattgcaaatgtccgctttacgtgagtagatgcaatagatacggaggtgataaatcttgaagtgcgaacgatgtggaaatcagctcgatgataccgatttattttgcccaaagtgcggaaaagcagtatttgaagagtatatggacgatgatgacatctgggatgaatatgacagagaaccaaaggttggatcgaaagaaaaattagaaatttcaaaagagattcaaccggagaaagcgtcaaaggtcgaagaaaccaaagaaagtccgaaagaggaaaataagcaggaagaggcggcgaaaatgccgcagattccaaaagaagaatccaagccaaaaagaaagacagaagcgaaaaaagcagacaaaaaaacaaagaaaacaacaagcaaaaagaccgaagaagtgtccggtaagaaaagtccggtgggattgatttgtgcctgtatcctgatggtatgtcttttgattggggtgctctggggaatgatgacggtcagacagatggagaaggagcaggcgacaaagacaacggcagataatagtcaggaacaggaaaatcaggcatcggtttcaaccgataatgcgaagacagaagagacaacgaaaccggataaggcagaagaagcagagcaaaaagagaatgagactaaaacagaagagcaggaacaacagccggaagcgaaaccagaagaagtagagcaaaagaaacaggactattttgttatggcggacaaagagggcatagattttagtcaatatacaaaacttacagttgcaaatgcggaacagagttccatggcaagttccggcaactatgattacagtgcgaagagtgcagcagatggagatattacttcatcctggcaagaaggtgtagagggacttggcgaaggaacaggaatcaaactcagcttagatggaacacataaaattcgttatatcgtattatatctcggaaactggagaagtgatgagatgtggcagaaaaatgcgagaccgtctaagctaagtatcaatttgggagacaatcaggcgaaagatgtagaattctccgatgaaaagaaagcattttgtctttcttttgatgagccggtagaggcatcttttgtttccctttacattcaggcaggttatgccggtgcaaagtggaatgacaactgtatttcagaagtggaattttatgaataaaagaatgagcgagaaaggattgattatcctctactcgctcatttttgttattgttcaatggtttttaaatgttctacaaacaactcttggattccgcggtattcgccgagtccttttaaaatcggtgttactttataaccggctgctttgaatttattataccaggaatcagggtcatctcctgccatatcattctttgcgtggtcaccggctacaatcataaatggagcaagtacgatttcttctggcttataagcgtctacaaggcgttttaagctgtcaattgatggataggcttctacggtagcaaggaagatatttggatgtcccttatccttaaatgcataatccagagcagcgtaaatagaatttgaaaaatgagttgtgccgtgtcccataaagacgagtgcctgttttttattcagccaggagaattcatcggctaaaatttcaatgactttattggtatcttcttcagaggtaagaagtggcgcaccaaatgaaatggaatcaaaagaatctttataggcaagcgcatcttctttcattaaatcattttcaattccattgataacgtgagttggctgtaccaggacattggtgattccatcctgcttcatctgtttcattgcctcagatacagtcataatgtgtacattgtctctggcatttacttttttgatgatcattttactggtccatgcacgatataaagaagcattcggacatgcattttttaaagcttcttcaatagcgtcaatggtgacttctcttgtgtcattgtggcttgtaccaaagctgacagcaagaattgcggtttttctttctacgtttgttttcatagttcctccctattgtgtagtattgatatttgtatcggaaatatatttttccagtgtttttaaattttttggaagcggaagagttgtctttaaaatttgtttttgacaaagactgtgaaacagttctaacacagcgggcggttccaaatttgttttttcaagcacacgaggatttgaaaaaacttcttccggtgcaccttgcattaaaacttttccctgatgaaataaaataacctggtctgcccattcataagcgtagttgacatcatgggtagccatgaaaacagtaattccggatttcgtcatgcgatttacaatttgatttaccatagtagtatgtttcggatcaagagcagcagcaggttcatctaaaataataatatccggtttcatcacaagaatatcagcaatagaaacctgttttttctgtcccccgcttaaagcatgagtaggtttatgacgaaatggtgtaatttcaagctcagcgattacatcttcaaccgcttttttggcgtcttcctcagagtatccgagatttaatactccaaaggaaatttcctgatatacgctcgcagaaaagagctgattgtcggggtcctgaaaaacaattccgattttgcttcgaagttttagaagccctttacggtcataagaataaggttccccgttataataaagagttcccgaacttggtttgtgaattccggtacagcagaggaaaaaagttgattttccggaaccatttgcacccataaatgcaattttctggcctcttggaatctccagggaaagaccatttaaagagtgtgttttttcatcatcataagaaaaatacaaattatctgcttttaagatgatatcattattgttcatgcaaaaaatttcctccagataaaaagaattaaaagaaacagttcaaaaagtgtaattaaaaaaattacatgttttttcggtggttgattttcatttaaaacgcgaatcgtgccatcatagcagcgggtttccatggagttataaagggcattggaacgttttactgcccgcaccataagggtagaacacattgctgcaaaagactttagcgaagttttatagttgcagtttccgagtcggcagtcctgagcagtagaaatatgataagcagtgtctaaaagcacgaagataaagcgataaattaaaagcattaattcaattaaaagttttggacagtgaagcttatcaagtaccattaaaatatcaggcattggtgtattcagagaaaggaaatacaggcaggatacagcagcaagtgcagtcaggattaattgaagggcataaaatgcgccatacgtgcttccggttaagtaccagtttccgatttttatagcaaataaatcgagtggtttttgtttcacgtttacaagaatcgccagtgtactcaaaaataaaaatgccagtggaacacttaagaaatgaagatagcgaaaaagggggattccacctttccatacagtgagaatccccgttactgctaaaacaattcctgcaattaccatggaacgactcattacacagataattaatgtaatcacggcaaaagcgaatttttctgcggcattttcatatctgagtctggaagtataacaaagtttatcaattgtaatcattcaagactcctttcttgtgacaggcgaaagaatcattcaccctttccaagctttttacgctctacaaaacgtcccatgaagaaagcaaggacgccgacaccgatagaagactgtacacagaacagtaaactttctacctcacccggaagttcatgtccaagcattttttctaaaattggttctgcaattggctggaaagaagagtcgacttcttcaacaacctggcttccggcatcatcagatccgccgaattcagcatcctttaaagcaaataatggaataaaggcaattaataaaataataaccaataaggtaatgactttctttttcatattattttgcctccttcataaatccgattgcacgaagctccggttttgcataagtttcaagtgccataatgattaatacagttaagataccttcgataattgcaagcggtacctgagttggtgcaaatacaagtaagaatttacccattgcatttaaaatggttgtatcagcgtgatgagcaagtgccatctgaactgcagttacacagtaagtaaataaatctcctaaagttgcagataagaaaatagcaaccattttatttactttgcatttctgacagactttataaattgcaaaggttacaaatggtccggcaattgccatggagaacgtgtttgctccgattgtagttaaaccgccgtgtgcaagtaagattgcctggaataataaaacaataattccaagaatggaaactgcacttggtccaaataagatagcgccaagaccggttcctgtcatatgagaacaacttccggtaacggaaggaattttcaaagaagagataacgaatacgaaagcaccggacatagccaataaggtaatcaggttgcggtgttcatttaatgttttcttgatggagaaaaatccggctgcaagaaatggcagacaaaggactccccaggcaacgcagtatcctgcaggaagatagccttccatgatatgcatagctgctacgtttggaacaataccaaacataagtgcaaatgcggtagcaaatgcgatgacgtgtttttgttgtttgttcattttcatgactcctttaacgtgataaagatttaaaataaaaaaacctgcggaagaattccggcaggccaagttgagaataaaaaacagactacgactgtgtagagtgttttcattcttacacaaggccatcgttcgtaaccatgtgtaaatcgtatgcagcaggcaggtcttctgacttaagcgtcattgcagcatttcgccttcccggtttcccagtggcaatgatgaaatgtgctctgctagttacagcggcgtgaccgtgcgggaattgcacccagctttcctattattccgaaaaaaacggacacctgtgtacattcaattctttgtccattgtattatttctcaaagcatttgtcaattcatttttaggcaaaaaccgacaaaaaaccttaggttgcaccgaggtacattctgtgctaagatgaaccaaggataagcgagaaaaagcttaaaaatataagaggcggagtgaagagaaaatgagtatttccatgattggaatcgatcacagcaaagcatctgtagatatccgtgcaaagttttcttttacaaagaaaagagcaatagaggcaatgaaaaagttaaaagaagaacacggtatcttaggatgcattattttatccacctgtaaccggatggaagtttgggtcagcacgcaggatgacgaagaaatttctctgtatgattttttatgcaaagaaaaagaagtagaaaaagatgagtatcaggattattttatgaaacgtgaaaatgaagaggcagttcggcatttgttttatttaaccagtggattaaaatcgcagattcttgctgaggatcagattattacacaggtaaaagatgcgctgactttagcaagagatgcctattgtacagataacgtacttgaagtactgtttcgtatggcggttacagcggcgaagaaagtaaaaacagaagtaacgttttcaagagccaatacttctgtgattcatcaggcaatggaacgcttaaaaaatcagggattttcgtttgagggaaaaacctgtatggtaattggaaatggtgaaatgggaaaagtgacggcacttgcgttaaaagaagccggagcagacgtaaccgtaaccgtacgtcagtatcgaagtggtgttgtaaacattccacagggatgtaaacgcattaattatggagaacgaatggaacttcttcctgattgtgatctggttgtttcagcaacagccagtccgaattataccttgacaaaagaaaactttgaggaaattaagttagatgcagcatctgtcgttttaattgatttggctgttccaagagatattgaccctgaagtaggaaaattacaaaatgtttccttgtatgatattgacagtttccgaattgatgcagcgtctccaaaacttcaggcgagtatgcaaaaagcaggagaaatcttggatgaccagatgaaagaattttatgactggtttaatggcagagatattttcccgaggattgaagagattaaagccgatgccgtagaggatttaaacttacgaattaccaaaattttaaaaaagactccaatggaacaaaaagacagagaaagccttttaagagcgattgatacggctgccggaaaagtggtaaataaaatgattttcgggcttcgtgattctctggaacaagaagcatttttagactgtgtggagggactggaaaaaatatatgaaagctgatgaaaaaaaatattttccgatgtttgtggatttaacacagaaaaaagtaactgtgattggcgcaggtaatattgcaaaacgaagaattgaaactttgctttcctttgccggtacaattgaggtgattgcaccggatgcctgtgaaagaataaaagaactggcaaaagagggcagactggtctggaaagaaaaagcgtatgacagggaagacttatatgatgcagatttagtgctctccgcgacaaataatgaaaaggtaaacaatgatgtttacagtgcatgtaaatgtcttgggatttcagtcaatatagcaagcaaccgaatgaaatgtgatttttattttccatcaattcttcagaaagaagaaacagtgattggattaaatagtgcaggaaatcctgcaaaaacaaaaaatgtgagaaaagaaatgcaaaaatggatagaagaagcaggggagaagcatgagtaaaaaagtgataattggcagccgtgagagccggcttgcagtaattcaaagtgagatggtaagagattatatcctttcttataataaagactgtgaagtagaactgctcacaatgaaaactacaggagataagatattagaccgtacgttagataaagtgggaggaaaagggctgtttgtcaaagaacttgacaaggcgttgttagaaaaaaagagtcagctttcggtacacagcttaaaggatatgccgatggaagtaccggaagaacttccgcttttagcattttccaaacgagaagacccaagagatgtactggtacttccggaagggatcaaagaactggatgaatcaaaaccgattggctgttcaagtctcagacgaactcttcagctaaaagagctgtatccgaatatggaatttaagagtgtcagaggaaatgtacagaccaggcttaagaaattagatgaaggacaatatagtgcgcttgtgcttgcagcagcaggattgaaacgtctgaagctggaaaatagaatcagccgttattttgaaccggaagaagtgcttccggcagcagggcaggggattttggcaattcagggaagaaaggatgaggattactcttatctggatggctataatgatgaggatagtgaatgtgcagcacttgcagagcgtgcctttgtgcgttacttagatggtggttgttcttctccggtcgcagcacatgcaaaagtagaaaaagacaaaataattttgaccggtctgtattatgaagaagaaagtggtgcatggagaaaagcaagtcttagaggaaaaagggaagaagcagaagaacttggaatccgtctggctaagcagttaaaacatccggggaaagtatggctggtaggagccggtcctggagatattggactgtttaccttaaaaggaatggaagtattaaaaaatgcagaagtagtggtatacgatagtctggttggacagggggtgctttctaaaattccaaagggagtacgtctgattaatgttggaaagcgtgcttctcatcataccatgccacaggaacagattaatcaggtacttgcagaagaagcaaaaaaaggactgcgtgtggtgcgcttaaaaggtggagacccatttttgtttggaagaggcggagaagaattggaactgcttcataaagagggaattccttatgaagttgtgccgggtgtgacttcttcaattgcagttccggcatataacggaatccctgtaacacacagagatttctgctcttctttgcatattattacgggacataagaaaaagggcgacacttatgatattgactttaaagccttagtaaataccaaagggacattggtatttttaatgggagtcagtgctttagaagatatctgtaattctcttttgcaggcaggaatggatgaaaagatgcctgctgcaattttgcaaaaaggaacaacagcaggtcaaaaaagaattgtggcaaccgtcagtaccctcgcagaagaagtgaaaaaacagggaattgagacaccagccattattgtagtcggaaaagtatgtgcccttgcagatgaatttgcgtggtatgaaaaacttccactctttggctgtaaagtacttgtgtcaagaccaaaagagacgatttcttccatggcacataaactgcgtttattaggagcagaagtactagaacttccggcaattcgtaccgagccattagaagaccagagtttgttaaaagaggcattgaaagaactggattcttatcagtggattgcgtttaccagtccaattggcgttaaagtattttttgatgaaatgaaacagaatagtgtggatgtccgtaaattggggcaggtaaaaattgcttccattggaaaaggaacaagaaaagccttagaagaaagaggattatttgtagatttgatgccggctgtatttgatggagattctcttggaaaagcgttgtgtgaagcctgtgagggaacagaaaaaattctgattccgagagcaaaaattggtggaaaagagattttagcacagttagcaaagaagccggggcttattgtaaatgatgtaccgacttatgataccttttatgaagaacaggaaatcattgacattaagaatctatttgaaaatggagaaattcagaccgcagtattcacaagtgcttcaacagtaagaggatttgtgaatgcagtttcggggcttgattttgagaaagtaagagctgcttgcattggaaaacagaccaaggcagaagccgacagctatggtatgcagacatttatggcaaaagaggcaaccattgacagtgtgacagatttggttgtagacttaaataaaaaataggatattctcagaattcgagagtgcccgataagtaaaataaaggagtgaagacctcatggatatgacaatccgaccaagaagattaagaaaaagtgaaacgctgcgtaagatggtacgcgagacaagaatggataaaagttctttgatttacccattgtttgtaaaagagggagaaaacatagaagaagaaatcccatccatggaaggacagtatcgttatagtattgaccgtctgccttatgaattagaacgcctgcagaaagcaggagttgataaagtaatgttttttggaattccggatgtaaaagatgaagtaggaagccaggcctatgcagaagacggaattgtacaaaaagccattcgtgaagcaaaaaaacagtttccggatatgtatttgattaccgatgtatgtatgtgtgaatatacctctcatggtcattgcggtgtactttgcggacatgatgtggaaaatgataaaacccttgaattacttgcaaaaacagcgctttctcatgtgcaggcaggtgcagatatggttgcaccgtctgatatgatggatggaagggttgcggcaatccgccatattttagatgaaaataattataaagataccccaattatgtcttatgcggtaaaatatgcttctgcattttatggtccattccgtgatgcagcaggttctgctccatcctttggggacagaaaaagttatcagatggatttccacaacagaagagaggcaatcaaagaagcactcttagatgtggaagagggcgcagatattatcatggtaaaaccggcgctgtcttatcttgatatcattcgtgaagtcagagatacgattgaccttccggttgctgcctattcggtaagtggggaatatgcaatggtaaaagcaggagcaaaattgggatatattgacgaagaacgaattatcggtgaaatggcagtcagtacattccgtgccggaacagatatctatctgacttattttgcaaaagaaatcgcaaaacttatggatgaagggagaattggataatggcaaaatcacaagaattatttaaacgtgcagtaaatcgaattccaggcggagtaaacagtccggttcgtgcttatggggcaatcggtgagactccaagatttatacagggagcagtaggaagcagtatttttgatgtagatggacagaaatacctggattatatctgctcctggggaccgatgattttaggacataatcatccggtgattcgtgatgcggtagttcgtgcctgtgaaaatggattaagttttggctgtgcgacagaacgggaagtagagatggcagagtttatctgtgagagaattccgcatgtagagatgattcgtatggtaaattccggtacggaagcagtaatgagtgcaattcgtgtagcaagaggatttaccggaaaatcaaaaatcattaaatttgcaggttgttatcatggacactccgatgcactcttagttagtgcaggaagtggagttatgacaagtggagtgccggacagcgcaggtgtcccaaagggctgtacacaggataccatgattgcagtttataatgatttagagagcgtaaaacagcttttagaggaaagcaacgatgaggtggctgccgtaatcgtagagccggttggtgcaaacatgggtgttgtaccgccaaaagatggatttttagagggactgcgtacgctttgtgatgaacataaagcactgttgatttttgatgaggtcattaccggattccgtttaaaattcggaggcgcagcagaatactttggagtgacaccggatttggttacttatggaaaaattatcggtgcaggtatgccggttggtgcttatggcggaagaaaagaaattatggaaatggtttccccggcaggtccggtttatcaggcaggaacgttaagcggaaatccggttgcgatggcagcaggtctggcacagttaaaactgttatgggaagatcaggatgtctataccagaatttaccgaaaaggggagtacctgtttgaaggaatccagaaaatcttaaaagaaaatgaagttccttatcaggtcaactatacggcttctcttggttgtatcttctttaccagtgaaaaggtaacagattataccagtgcaaaaacagcagatacaaaagcctttgctgaatactttaagtatatgctcaatcatggagtacatcttgcaccgtctcaatttgaagcaatgttcctttctgatgcgcatacacaggaagaactggacttgactttggaactggttgagcagtattttaaaacatggtagagtctatgacatcaacacaagttgcatgcggagcgcttctcttatttgtatttgcactcgtctggtcaatggtaagggaaaataacaaaagaaaaaagaaatttctcgaaaaaataaagaaaagctggggagctgtcccaacacgggaatatagctgggatgagttagagcagatatcggcttatcataaagcacagccaaaaaacagctttgtgatagatgagattacctggaatgatttggatatggaccggattttcatgttgatgaatcagaccgtatcgtcggcaggagaagactatctttatgcaatgcttcacagaccggaattttcagaagagagattaaaggagcgggaacggctgttttgtttttttgaaaaagaagaaaagacaagaattcgttgtcagcagattcttacaacgcttcgtaaaccgagaggactttctttgtatcagtcaattcatgttgaaaaagactgccaagttggctcgccgatacgggaaattctttcgtgcgtgctcttttttgcatcgcttgtcgcatttatggtagttcctgcttatggagtgtttgcatttttagcagtgagtggaatcaatattatcacttatctaaaagggaaagaagagattaaccggtatttgggtggatttcgcagcgtgatgcagttaatcggatgtgcagacacactggaaaaggcaggaatttcggagctttcagagtatacaaagaggttaaaagactgtaaaaaggcactgggcagttttagaaaaggctcgtttttagtagtcaaccatgatggaatggaaaccggtccggaagcggtgatgcttgattatattcgaatgatgacgcatattgatttgattaaatttaattcgatgatgaaggcaatgagagagcatcaaaaagaaatcgaagagatgatagaaatttttggactgttagatgcctgtatttcaattgcatctttccgggaacttctgccgtattattgcagtccaaaatttgattccgataaaaagagggcagtattagacgtagaaaatctgtatcatccgttgattttggaaccggtggcaaacagtataaagacaacgcaggcggtgcttgtaacaggctcaaatgcctctgggaagtcaacctttttaaagatggttgcaatcaatgcaattttggcgcagaccattcatacctgtatggctacagaatgtaaaatgtcttattttcgtgtgatgacgtctatggcactccgggatgatttggaaagcaaagaaagttattatattgtcgaaattaagtctttaaaacggattttagattccgcaaaagaagaaacacctctgctttgtattgtggatgaagtacttcgtggaacaaataccattgagagaattgcagcttcttctgaaattctggcctcgctttgtcttccgcatgtcctttcttttgcagcaacacatgatatagaactgacttacatgttggaagagtattatacaaattatcattttgaagaagaagtaaaaaaagacgatgtcaaatttaattatcttctaaaaaaaggaagagtgaccacaagaaatgcaattcggcttttaaaaatgacaggatatgacgattcaattgtagaagcttcaaaaaatgcagttgtccgatttgaacaagagggcagttggaagaaagtaggagaaaattagatgtttgtaaagatatatacggatggtgctgcaagaggaaatccggatggaccaggcggatacggatgtgttctgcattacaccgatgcaaagggagaactacatgaaaaacggttatcaaaaggatatgtgcggaccacaaacaaccggatggaactgatggctgcaattgcaggttttgaagcattaaaatgtccctgtgaagtggaactttattcagattctaaatatttagtggatgcgtttaatcagcactggattgatggatggttaaaaaagggctggaagcgtggaaaaaacgaaccagtcaagaatacagatttatggaaacgtctgttaaaggcaaaagagcctcataaagtaacatttatatgggtgaaaggtcatgacggtcatgaaatgaatgagctttgtgattttctcgcaaccacggctgcagatggaacagatttaagtgtggatgagggaatctgataaaaatcagggaagtttcggattttgagaaaagaatatttcttgaaacctgaaacttcctgtgctattataaaaaacaaacgtgttacacttttatatattttttaaagtggaaacatttggaaacatcaggaggtagaaccgtgcagaaatacggagtaaacgaacttcgaaaaatgtttttggagttctttgaaggaaaaggccatttggctatgaagagtttttctcttgttcctcataatgacaagagcttattattaatcaatagtggtatggcaccacttaagccatattttacaggggcagaagttccgccaagaagaagagtgacaacctgccagaaatgtatccgtacaggtgatattgaaaatgtaggaaagaccgctcgtcatggtacattttttgaaatgcttggaaacttctcttttggagattattttaaaagagaagcaatccactggtcctgggaatttttaacagaagttgttggacttgacccgaacagattatatccgtctgtttatcaggaagatgatgaagcatttaaaatctggaatgaagaaatcggaattgcaccggaaagaatcttccgttttggaaaagaagataatttctgggaacatggtgcaggtccttgtggtccttgttctgaaatctattatgacagaggggaaaaatacggttgtggaaaaccaggatgtacagtaggctgtgaatgtgaccgttacatggaggtatggaacaacgtatttactcagtttgaaaatgatggagaaggacattataccgagctggttcagaaaaatattgataccggtatgggactggaacgtcttgcagtcgttgttcaggatgttgattctatctttgacgtggacaccctttgtactttaagaaataaagtctgcgagttggcacacgtagaatatcagaaagatgatgcaaaagatgtttctatccgtctgattacagaccatatccgttcttctacctttatgatttcagatggtattatgccgacaaatgaaggaagaggttatgtccttcgtcgtttgattcgccgtgcagctcgtcatggtcgtcttcttggaatcgaaggaaaattccttgcaatcttaagcaatacagtaattgaaggttcaaaagatggctatccggaacttgaggaaaagaaagactttattttccaggtattaaccaaagaagaagaacagtttaataaaacgattgaccagggtcttcgtatcttagaagagttagaaacggaaatgaaagaaaagaacgagaccgaactttccggtgaaaatgcatttaaactgtatgatacttatgggttccctctggatttaacaaaagaaatccttgaagaaaagggatataccattgatgaagacggatttaaatctgcaatggaagaacagagaaacaaagcacgtacagcacgtgaagtgacaaattacatgggagcagatgcaacggtttatgaccagattgatgcagaggttacaactgaatttgtaggttatgatcgtctggtacatgaatcaaaagtaactgtacttacgactgaagaggagctggtagatgctttgacagaagaccagaaaggtacgatttttgtagaagagacaccattttatgcaaccatgggtggtcaggaaggcgatactggtgtgattacctgtaatggagcagaatttgtggtagaagataccattaaactgcgtggcggtaaagtgggtcatgttggaaaactgacaaaaggtatgattaagacaggcgatgttgttaccttaagtgtcaatgcaaaagaacgtgctaatacctgtaaaaaccacagtgcaacgcatctgcttcagaaggccttaaagacggtacttggtgcacatgtagagcagaagggttctttggtaacaccggacagacttcgttttgactttgcacatttccaggcaatgactgcggaagaaatggaacgtgtagaagcaatcgtaaatgaagaaattgcagagaatctgccggtagaaactcagattatgagcattgaggatgcaaaaaaatccggagcaatggccttgtttggtgaaaaatatggagatagcgtgcgtgtggtatccatgggagatttctcaagagaactctgtggtggtactcatgtaccaaatactggtgtgattacaacctttaagattgtatcagaagctggtgttgcagcaggcgtacgacgtattgaagcgctgactggtgatggtgtattccattactataaagaagtagaaaagaaattaaatgaagcagcaggtgctttaaaaaccacaccggctgaagtacttgaaaaaatttctcatctgcaggcagaaatgaaagcactgcacagtgaaaatgaatccttaaaagcaaaaatggcacaggatgctgttggcgatgttatggaacaggtaaaagaaatcaagggagtcaaattccttgctgtagcagtagaagatgttgatatgaacggtctgcgtgacttaggcgaccagatgaaagaaaaaatcggcgaaggtgttgttgtgcttgcaagtgtaaatggaggaaaagtcaacctgcttgctatggcaacagactctgcgttaaaagcaggggcacatgccggtaatcttgtaaaaggaatggcagctgttgttggcggtggcggcggtggtcgtccaaatatggctcaggccggcggaaagaatccggaaaaagtaccggaagcacttgaaaaagcagctgaaatcttagaagaccagattaagtaagaaaaattttaagaaattttcataaaatagttgacgtatgagaaaaatctgatataatgtttttgtgcaataaaaatacccagacagttgtattatgcacaatctacaactggagggaggttaggtgtgagactatgtcaaatgtaatcgtaaaagagaacgagactttagatagcgctttacgtcgtttcaagcgtagctgtgcgaaagcaggcattcagcaggaaatccgtaaaagagagcattacgaaaaaccaagtgttcgtcgtaagaaaaaatctgaagcagctagaaaacgtaaatataattaatgtgcagtaaaagcctctggtaattcccagaggcttttttactacagcgattaaggaagcagaaaagcatgaagaaactgattgatttgatttccagccgtttttttgtatttgtatttgcagtgttactgcaggtgatatggttgttactgatttcgtggggaatgagcagtctttctgcaccggttacaatgacagcagatattttgagtatattattggtattatggattgtaaataaagaaattaatccgtcgtacaagttggcctggactattttgattttagtacttccggtatttggaatggtcgtatatttgttatttggagagtcaagagttgcaaaaaagatgacagaagagtcagatgcagttgtacaggaaattgaaaattatttcagggaaaatgataaagtaagagaaaaaatagaggctttggatgaaggaatttccaatcaatccgcttatatcagagattatgcaaagtttccgcttcatagtcatacttccaccaggtattatccgctgggagaggcaatgtttttggatatgctggaagatttaaaaagggcaaaacattttatttttctggaatattttattatccatgaaggtaaaatgtggaactctattctggagattttagaacaaaaggtaaaagagggcgtggatgtccgtctgatttatgatgatatgggctgtgttacgacattaccgcaccgatattataaaaagcttcaggcaaagggaatcaaatgtgcggcatttaatccggttcgtccaattttaaatattgtattaaataaccgtgaccatagaaaaattctggtgattgacggacataccggttataccggaggtattaatctggcagatgaatatattaacgaagaaatccgatttgggcattggaaagatacaggaatccgcctgtatggagaaggagtatggaacctgactgtcatgtttttacagatgtggtcgattatcacaggggttcgtacgcatataccggcgtacagcccttatgtatttcatacagaagaatttgaatcagatggttttgtacagccttatggggattctccgatggataatgaaacggtaggagaaaatgtctatttaaacatcattagtcaggcaaagaagtatgtgtttatctgcacaccgtatttgattattgacaatgaaatgatgatggcattatgtctcgcagcaaaaaaaggtgtggacgtgaggattattacaccggggattccggataaaaagatggtctttcttttgacgcagtcttattataaacagttaatagaagccggagtacgtgtgtatgaatacacacctggatttgttcattctaagacctttgtatgtgatgacgaaattgcgacagttggaacgataaatctggattaccgcagtttgtatctgcattttgaatgtggggtatggatgtatcaaagccaggcagtgagagaagcaaaagaagatatggaagcaacacttccaaaatgtaaagaagtcagtctggatttttgcaacaagagaaatatttttgtaagaggaatacagagcattatgcggctgattgcaccgcttttatagagtgtgtgcttaagaaaaactttgagagtgcacaaaaggtagaagtaagcaaagaagaatacagggggaaaagtatgctgatgaacttttttacccgtgccgttttgggtacggatttttaccatattattcaatggtttctggtttatggaattttgggatggattgtagagtctgtttatatgtcaatctgtaatcgaaaactgaccaatcgtggttttacacatggaccgatttgcccgatctatggatttggggcactgacagtttatttcctgctgcgtccgtttgcaggaaatctggttctgctttatattatgggctgcattgtgccaactttactcgaatatttgacagctcaggtgatgttgtttatatttggggaagtctggtgggattataacgaaaaaccatttaattataaagggattctctgtctggagagcaccattgcctggggcttttatacagtaggattattcttatttttgcaaaatgcagtagaacggtttgttgacagttattcatttgaaattggctgtgtggtaagtacatttagtattatgctgtatatggttgatttttcttacagtttttatcaggcaaaaaagagtgaccttccagagggaatggaagcattttggacgcagattaaagaatggttttaaaagaaaaaaattgagtaagttccataattaaagaaagtgatttatcataaatcactttcttttttcataccataaaacaaggatgctctttggagagagcagatgataaataagattgtctcatacataatggtaatctgccttttctgtgccgttccacaggtagtatttgcagatgaaactgtgattacatctccacatgctgtcttaatggaagcctctaccggaaaaattatttatgaaaaagaaaaagatgtacaggtatctccggccagcattacgaaaattatgacgctccttttgatttttgatgaaatagccaatcaaaatcttgattttgaagatgaggtgacaaccagtgcttatgcaaaatctatgggaggttctcaggtttatcttgaagaaggagaaaaacaaagtgtagaaacgatgataaaatgtattgtcattgcatcaggaaatgatgcgagtgtggcaatggcagaacatatctgtggaagtgaaacagaatttgtaaaacggatgaatgcgcgggcaaaatctcttggaatggagcatacaaattttgaggattgttgtggactgaccgactctgacaatcattatacgacagcttatgatgtggcgctgatgtcaaaggaactgattacaaaatatcctaaaattctggactattcttcggtctggatggaaacaattacacaccataccaatcgtggggacagcgagtttggactgacaaataccaataaactgattcgaggatacgatggctgtgtcggcttaaaaaccggaagtaccagtaaggcaaaatactgtgtttctgcagtagcaaagagaaatggattgacgttaatcagtgtgattatgacagctccggattataaagcacgttttcaagacggcgcaacactgttaaatcttgggtttgctacctgcagtctttatgaagataagagcactgtgaaaaagaaagttccagttaaaaaatcagtacaaagagaaggaatttgtgaaaacaaaaaaaagttttcttatctggacacggaggggaagtccctttctaaaatagagaaaaaaatacaattaaaagaaagtgttgaagcacctgtaacaaaggggatgaaagccggagaaatacaatattatctggaaaatgaaaaaattggaagtatagacctcgtttttagtcaaaatatcgaaaaagcacgctacgtcgattacttaaaaatggtgcttgagaaatttttcagaaatagggattgaagtttaaaaaccattggattataatggctcatggtaaaaacgaaatgcagaaaaaggggaagaaaaaatgcaacaggatatgacagccggaagcccggccaaggccattttaatgtttacggttccgatttttgtcggaaatgtatttcagcagttttacagtatggttgatacaattattgtaggtaagtttgtaggaacaacagctcttgcagcggtcggaagtgtaggaactatcatgtttttaattattggttttatgcttggtcttactgcaggctttacagttttaaccgcacagcgttttggtgcgggagatatgaaaggcatgagaaaaaccgtcggaagtgcggcaacattgtcggtaattatgacggtaattatgacgaccatcagtatgcttgggatgaagccgttattaaaatttatgaatacgccatcagatatttttgcggacgcttatcactatattatggtaatttgtgcgggtatttttgcaactgtattatataatcttttggcaagtattttgcgtgcaattggaaacagtcagattccgttatattttctgattttatctgcactgttaaatgtagtattagatttattattaattattgtatttcgtatgggagcagcgggtgccgcttatgcaactgtaatttcacagggtgtgtcaggggttctttgtctgatttatattataaaaaagataccggaattaaaattagaaaaatccgattttcagttaaatgggcatattgcaaaagttcagattggaatcggaatcccgatggcacttcagtattctattactgcaatcggaagcatgatggtacagtcctctttaaatgtgttaggttcaggtgcagttgcagcatttacggcagcaaataaaatcgaacaggttttaacacaggcctatgtcgctcttggaacaaccatggcaacttactgtgcccaaaacattggtgcaggtaaagtaaaaagaatccgccagggatttcgtgcagcaacgattggaggatggatttactctgtcatagtaggtctgcttctggcttttgttggcaagtattgtaccattttgtttgtatcaggagatgcaactgcaatcatggatcaggtggatatttatttgaaatgtgtatctgcatttttgttcccgcttacgattgtaaacgtctatcgaaatggaattcagggaatcggttatggatttttgccgatgatggctggtgttgcagaacttagtggaagaggtattatggcagtgattgcaggaaaacagagaagttatcttggaatttgtcttgcaagtccggttgcatggatttttgcttccgttctgcttttagtgatgtatgtgattgtaatgaaacagcaggagcgtatttttgcaaaaagaggtcagaaataaaaagtttgcgagagtacataaaaaataagagagtacataagagaaattaagagaaaaaagtattagctgaggaatcggttaatgctttttttttgagcgtaaatgcgatacaatgatgtgagtgttaaaagaaaacaataaaaaacagacaaaattagaaagaaaaaatagtagaaagaataaagagcaggaaaataaaattgaaaaaatttaagattacaaattatgagataacttcagagaaaataagccaggaactgagatttgtgatgattagtgactggcataatgttatatttggagagagaaacaagccggtatttgaggcaattcaaaaaataaacccggatgccattttaattgccggagatttggtacttggaaaacaggaagcaccgcttttgccggcattagaaagtttaaaagaactgataaagactgcaccggtattttatgcacccggaaatcatgaacagcggatgaaacgttatccgcaaaattatgaagcttcgtttttggaatacgagacacagataaaaaagctgggggttcattatctggaaaacgaacaggaggttcttttggttaagggcgaaaaaatccagattcatggtctgaagctgccttatgagtattataaaaaaggttcaaaaaaagcaaaaacaggtccaaaggaagaagaattaaagacgctgcttggaaaaccggatgagaacgaatttcatattttattggcacatacaccgagatatgcaaaagaatattttaactggggagcagatttgaccttgtccggacattatcacggcggagttttaagacttccatttggtggaaaaggtgcattaagtccggattttgtgctgtttccaaaatactgttatggattatttaaaaaaggagaacaaaaattgattacgggttccggacttggggaacatacgattccaatccgaatcgccaatccgagggaacttgtggtgatttcctgcaagccaaagagaaagtagactttttaaggaaaatcatgtaaaattgtgtgagttgctttgcagtaaaaagattttaaccaaattaagtaagtcccctgcttcaattgcgaaaagcaataagcaggggtggggacttgcttgtatcaggagggggcaagccccttctgataagctgcgtagcagctatttggttatgagcaagtagcgaagcggattgcgaatatccacttgactctcctaagagtgcatgtaaaatattaaaatcatcgagatagacaagaaaggtgagaaagaatgggaattcccgtaaaacttacggtgtttgaaggtcctcttgacctgttattacacctgattgagaaaaataaagtaaatatttacgatattccaatcgttgaaattaccgaccagtatatggattacatccatcagatggagcgggaagatttaaatattatgagtgaatttatggtaatggcggcaactctgatttcgattaagtgcaaaatgctccttccaaaagaagtggatgaagagggagaagaaaaagacccgagagaagaactggtgcgtcagcttttagagtataagatgtataaatatatgtcctatgaactgcgtgataagatggcagaggcagcgaaaagcatctataagcttccatctcttccaaaagaagtagaggattataaagagccgatagacccacaggaattactggcaggaatgacgcttgcaaaactgcataaaatctttgaagacgtgttaaggcgtcaggaaaataagaaagacccgattcgcagcaaatttggaaaaattgagcaggaagaagtcagcctgccggaaaaaatgagtgatgtggaactttatgcaaggacacataagcagtttagttttcgtgaacttttgggaaaacaggcaagtaaatttcaagtggttgttacatttttagcaattcttgaactgatgaaaaccggaaaaatcagaatttatcaggaacatatttttgatgatattcaaattgcatcgttggtataagacaggaaaaataaatggaatgtgttctcagaagtcgagaatacatagaaaaatggggagaaaaaaatggatattgaacattatgaaggcgcaatagaggctctgctttttgcaatgggaaaatcggtcagcctctctgcgattgcaaaagcaattgggcatgatacagaaacgacccgcaaaattattgataatatgatgctttcttataatacggcaaaaagaggcattaagattattgaactggaaaattcttatcagatgtgtaccaaagaagagtattatgattatctggtgaaactggcattacagccaaaaaaagcaagtctgtcagatgtcatgcttgaaactctgtcaattattgcgtataaacagccggtgacaaagttagaaattgagaaaatccgaggagtaaaatgcgaccatgcaatcaataagttaattgaatacaatctgattcaggaagtaggcaggttagatgcaccgggacgtccgattttattcggaacaacggaagaatttttaagaagttttggagtacatggaattgaagaactgccggaacttgacccggttcagatagaagattttaaggcagaggcagaagaagagattcagctgaaactggatgtataaatttaaccaaatcaagtaagtcccctgcttcaattgcgaaaagcaataagcaggggtggggacttgcttgtatcaggagggggcaagccccttctgataagctgcgtagcagctatttggttatgagcaagtagcgaagcggattgcgaatatccacttgacggttaaggatatctgaaatttgacgtatgattttgagatgaaacgaaagttttgtgaaaaagttctgataaaagtgggacaggcatatattaataaaaaagtatgcagagaaaaatatgaaaaaaatcttaagcattactttcattttagtattcttttggggcagtattcaaaagaatctcctgcctgtctttggtgcagacaatcagagtcccggaacactttattcggaatccgcagttttgatggatgcagattcgggaagaattttatatgagaaaaacggatatgaacaacgaccgatggcaagcacaacaaaaatcatgacctgtattctggcattagagaacgggaaagaggaggatatcgttactgcttctgagtatgctgcatcaagaccgaaagttcatcttggagtaagaaaaggagagcagtttcgctttggcgacctgctctattctcttatgttggaaagtcacaatgatacggcggtcatgcttgcggaacatttagaaggtgatgtagagacatttgcggataaaatgaatcagaaagcaaaaaaaatcggatgcaggcataccttttttattactccaaatggattagatgccacaaaaaaaacaggagaaaatgagcaggttcattctacaacagcggcagatttggcacgaattatgcgttattgtattaaggaatctccccaaaaagaagcgtttttaaatattacaagaacgcagagctatacgttctgggatatagaaaaaaaacggagtttttcttgcaacaatcataatgcatttcttagtatgatggaaggagcattaagcggaaaaaccggatttacggcaaaggcaggctactgttatgtaggtgctttaaaaagagaagagaaaactttgattgtcgctctgcttgcctgtggctggccaaataataaaacgtataagtggaaagatacggtcaaacttatggagtatgggctgaatcaatacgaacaaaaatcattgttagagcagggaacattttcgctgccagaaacacttgtggtagaaaatggacaggcagagaaaattggaggagaagcaagtgttcccataaaagtgaaggctatacaagacaaaactcttttaatgcgaaaaggagaatcggttcgagtcatttatgagggaaagacaaaattgtcagcgccaataaaaaagggaagctgtgtgggaaatttaaagtatatcgtaggggactgcgtatatttaagccgtccggtttataccgcaaaaagtgtgaaagcaatcgattataaatggtgtctggaaaagattgcaaagcaatggacatttacttttccggataacatggtagaatagaagaaagagaaaatttaagaaacaaaaaaattaagtttaagaagaattaagaagaatgtactcttagaatggaggaaagaatgtcagtaacagtaatgagtttttccggagtctataaggaacaggaattttatcagagtaagcgaatagataagcgtgtggaagcagaacaggtggaagagacaaactgttattgtaccgaagaagcagaagaaaaaattaaaaagttgatagaatcttaccctgaaaaagggattcattttctggattcaggaaactatcattatgtgacaaaattctggatggaaaagctaacaaaaccatttgcactggttttgtttgaccagcataccgatatgcaggaggcagcgtttttcggacttctttcctgtggaagctgggtaagggaagcacttgaacaaaatgaactgttaaaagcagtctgtgtggttggacctccacaaaagtcaatagaagaggtttttaaaagcagcaaagaagaaccttggatagacaaagtctgttttgtttcaggagaagaattagaagcgcacagacaaacggcttatgacgaatttttaaaagaaaattctattccggtttatctttcgattgataaagatattttaagagaagaagatgcttctgtaaactgggaccagggaaagacaagtctcgaagaattactggcacttgtaaaaagctgttttgaaaaacaaaccattgcaggtgtagatatctgtggagaaaatgcgaaaaaagagggaaactgggaagtttcggaagttgaaaaaaacaacaagacaaatttgattctgttagaaacaatcggacagtggatgaaagaacaggaagtgaatcgttgaaaagggaagaagaattagaccggaaatttctgacaagcggtcaggaaaaagtaaaactggaaattgcattaatgcggtattttgaactggcaaaagataaaaataaagatttcttatcggaaatggaacagacttatcagaactatctgcttaagcggtttcgtccggcaatggaaaccttattagaacaaaaagagaacaaaaaaatgagacaactatttttgcaaaaaaagatgaatcaggggcttttagaagagttacttttgatggcatcaaaagcacataatacagaagcattcttatggcttttagaacaaaaacaggctctgtatgggtttgaaaaaggggatatggaattatgaggcaggcagaagaaatttctaaggatatctggaaactggcaaagcaggaaatttcttgtgcctgcccgttttttgctcctctattagaaaagatagaaattttggggcaaaatgagcgcaaaagttacggtctggatggattccggatgtggtatgaaccgtttgaacttttaaatacttatcaggagcagggaagaaaaaaaatcaatcgtatgcttctacacagcctgtttcatcttttgtatctgcatctggcagaaaaaaagcgggaggaaacacgctggaatctggcatgtgatttagtggaggaaacacgctggaatctggcatgtgatttagtgacagagtatacgattgactgtttaaaacttccgtatctgacaggagatgtgcaagcgcaaagaaaagaaatctatcagaacttctggaaagagggagagggaaaaacggcaggacaaatttatgaaagtttgagccaatattcagacacagagataaaaaactgggagcggatttttgcatccgactctcatgaactttggcgcaaactgaccgaagaagaaatagaagggttaaaaacacagtgggaaaaaatcattgcaaagactggttcagaagggggatttagtaaaaataaagcgggcatgcaaaaagggacaacaaaagagtggtatgaactgcaaaagaagaaaagacgggattatcatcgatttttacagcgtttttcaatcaaacgggaagaagtacaggcagatttggatagttttgattatattccgtatcattatggactctgcatgtaccaaaatatgccgtttattgagcctttagagtatacagaaacaaagcggctggaggaacttgtcattgcgattgatacctcaagttcctgttcaagagaaatggtgcagttttttttagaggaaacagcagggatgctgggaaatcaggaaaatttctttaaaaaatttacggtttatctaatccagtgcgacagttttattcaggatgtggtattaattacaagcatggaagagtggaaacgatacagcaggaaaataaaaattcagggaagaggcggaacggattttcgaccggtatttgaatacatagaaacgttaaaacaaaagaaaaaactaaagcatctcaaaggattgatttatttttcagatggagatgggatttttccgaatcaggaaccggattatgaaactgcgtttgtgtttttaggagaaccaaaagaaaacgtaaaaattccaaaatgggttctttctttaagtttaagcaggacaaaataaaattaaatttcaaagtctggaatagaaagggtctaaatatacagaaaaaaagaaaagaggaaaaaagatgaacattgcgcaggcaaaagaagaaattaaaaatactgtacggatctacacaagaaaaaatgaagacggaagttataaaatagctcccgttcatcagcgaccggtgctgttgattggacctccggggattggaaagacagcaattatggaacaggtggcaaaggaatgtgagataggtcttgttgcctataccattacacaccatacgagacaaagtgcagtaggactgccattaattaaaaacgaagtatttggtggaaaagaatacgcagtgaccgaatatacgatgagtgagattattgcatcggtttatcagtgtatagaaaaacagggatataaagaaggaattttatttatcgatgaaattaactgtgtctcagagacgcttgcaccgactatgcttcagtttcttcagtgtaaaacatttggcacacataagattccggatggctgggtcattgtggcagcgggaaatccgccacagtacaataaatcagttcgagagtttgatattgtaacattagaccgtgtaaaatggattgaggtaaaagaagattattctgtatggagaaattatgcactcaaaaataaagtacatccatcgattattgcctatcttgacttaaaaaccgaacaattttataaaatcgaagccacggcagatggctatgcatttgtaacggcaaggggttgggaagatttatccagaattttatggatgtatgaagaattagagcttgagattactgtagaatttttatttgaatatcttcagcacgaagaagttgcaagaggttttttaggattttatcagctttgtaaaaggatgaaagaagaatatgggctgatgcagatactagagggaacgataggtgaagaaaagttagagaaagaaatttttaaactcaaagagacagagtttgatgcaagagttgcaatcctgacttttttgagtgatggaattcatcaaaaaatagaaagttatgataaaaaagaacagaaagtccggattcagtatcaggaagcaaaaacacttctggagcaattagaaaacaaaaaagagacagatcgtttttctgaactgttagataggaaaattgagcaggaaaaacatgcttttttggtaaaaaaagagcagggcttactgacaaaagaagagaaatgggaaaaagaacaacaaagagaatggcttgaggaattaaaaaatgcgtggaaacagtctggaacgaagagcggaacagaacaagaactcattcgtgcctgttttaatcagaaaagagaagtacaaaaacaggaaaaagaaaaaatgcaggaaattttagaacgagcttttgactttgcggggcgtgcatttggagatgggcaggaaagcgcaatgtttgtggagcggctctcgatggatgaacgtattttaaaatttattcaaaaaaatggatgtagtgcatatcaaaaagccggagcatgcatacaggcagaagaacgtgaagaggaacttcaaaacgaaatccagaaattgacaaatttcttacaaaaataacttgactatttttgtccgatttattataatacacttaacgagaaaaattatcaaaacaaaaacagaaattgaatctggataaaaaagttgagttacaggaggaaaaaaagaatgaatggatgttttggatgtaacacatgtgcaagtgcagataaaccactggagggatttatcagaaacctgccaatggaaacttctcatcatagagtagagggacagagtacaaaatgtggatttggacttcagggagtctgttgtcggctgtgttccaatggtccttgtagaattaccccaaaagcgccaagaggaatttgtggtgcaacggcggacgtcattgtagcacgtaattttctgcgtgcagttgcaagtggttccggctgctatatccatatcgttgaaaataccgcattaaatgtaaagaaaacagcaatggaaaaaggagaaatcaaaggagaacgttcccttaaaagacttgcagatgcatttggtgtccagggaaaagataaatgggaaaccgcacagattgttgccgaaaaagtaattgctgatttatataaaccagaatatgaaaaaatggagctggttgaaaaattagcttatgcgcctcgttttaaaagatggcaggaacttggaattctgccaggtggggcaaaaagtgaagtgttccatggtgtggtaaaatgttctacaaacttaaactcggatcctgttgatatgctgacagactgtttaaaacttggtatttctacaggattatatggattgaccttgactaatcttttaaatgatgttctgcttggagaaccggaacttcgcatggcaccggttggactgcgtgtaattgacccagattatattaatattatgattaccggacatcagcacactatttttgttgatttacaggaaaaactgatttcaaaagaagcagtagaaaaagcaaaagcagttggtgcaaaaggctttaaattagtgggatgtacttgtgtgggacaggatttgcagcttcgtggttctcactatacagaagtatttgatggacatgcaggaaacaactataccagtgaagcagtccttgcaaccggtgcaatcgatgcggtaatttctgagtttaactgtacccttccgggaattgagcctatttgtgacagtttaaaaatcaaacaaatttgtctggatgatgtggcaaaaaaagcaaatgctgaattaaaaccatttgtatttgaagaacgtgaaacacaaagcatggaaatcattgatgaaattatagaagcttataaagaaagaagaggaaacgtagaatttaatctgatgccggaacatggaaatgaccataccttgaccggagtcagcgagttgtctttaaaagatttccttggcggaaactggaaaccattaattgatttaattgtagccggagaaatcaaaggaattgcaggtgtagtcggctgttccaatctgacagcaggcggacatgatgtgttatccgtagagctgaccaaagaacttatcgcaaaagatatccttgtcttaactgctggatgttcttcaggaggaattgaaaactgtggtcttatgacaccggaagccgcaaaacttgcaggtccgaaactgcgtgcagtctgtgaaaaattaaatattcctccggtattaaattttggtccatgtcttgcaatcggacgcctggaaattgtggcaacagaacttgcagaagcaatcggtgtagatattccacagcttccactggtgctttccgcagcacagtggttagaggaacaggcactggcagatggctgctttggactggcacttggacttccgcttcatcttggacttccaccatttgtaaccggaagcaaaaccgtaaccaaagtattaacggaagatatgaaggaactgaccggtggtcaggtgattatcaatgctgacgcaaaagaaagtgcggatattttagaaaaaatcatagaggaaagaagaagcgcattaaacatctgataaaggagggaacagaaaatgagacgaattatgattgactcagctaaatgcgatggctgtaaaagctgttctcttgcatgtatgcaagcacatcgagaaacaccgggaacaatctatgacttagatgtaacagactgcgcaaatgaatcccgaaattttatttataaaaatcagaaaggcggatatactccgcttttctgccgacactgtgataaaccggagtgtgttatgtcttgtatgagcggggcgcttaccaaagatgaaaagacaggtcatgtccagtatgatgagacaaaatgtggttcttgttttatgtgtgtaatgaactgtccatatggagtgttaaaaccggatgaaaagacaggaatgaaaattataaaatgcgacttctgtattggaaaaggagaagatccaagttgtgtaaaagcctgtccaaaagaagcaatctgggtagaggaggtgtagcagatgaagtatgtaattattggtgttggagcagcaggaattatggctgcaaagacaatacgaaaagcagataaagaatcttctcttactatgatttctctcgatacccaggttcactcaagatgtatgctgcataaatatctttctcatgaaagaaatgaaaaacagttaagttttattccggagaatttttttgaagaaaatcagattatctggaataaagcacagagcgtaaaacagcttcatgtaaaagaaaagcaggtcgaacttttagacggaacaaaagttgagtatgataaacttttaatcgcaacaggcgcaaacagttttattcctccggttggaaatttaagagaggcaaaaaatgtctttggtcttcgacatttaagtgatgcacaggcaattgaccaatctgccaaagaagcggagaatattgttattattggttcaggtctggttgggcttgacgcagcttatggtctgatggaaacaggaaagaatgtttcaattgttgaaatggcagaccggattcttccggtacagcttgataagacagcagcaaaagaatatcagaaacgttttgaatctgcaggagctaagttttatcttggaagaaaagcagcagaaacaaaaatggatgagaacggaaaaattacgacggttattttggacaatggagaagaattaaaatcggatttgattattgtggcagccggagtgagaagtgcaacagcaggttttgagacagaggaaatcatagtcgacagaggcatgaaagtagatgagtttatgcagacaggagcaaaagatgtctatgcagcgggagatgtaaccggactttccggaatctggccaaatgctcagaaacagggagaaaccgcagcacttaacatgatgggcggacgtgtcccttatacggatcgctttgccgctaaaaacacgattaatttctttggattaaattcactttgcgttggcgaaattgtaccaaaagagacagatgtggtgattacaagagaagatgcttctaactataaaagagttatcattcgagatggaaaagtagcaggagtactgcttcagggagatatttcccatgcaggaatctggcagtacctgattaaaaatcaaatttcggtagcgggtatcaaaaaagatatttttgcgctgaatttcagtgatttctatggaatcaaagaaaatggagaatatgtctggaatttttaaaaaggggttgacaaagtccgtattttctgggtatactttgtttgtcttaagacagaaatttcagatagaaaaaagcagtgagaggaacaagtagtcaccgaaggaatctacagaaagcagccggaagatgagaggcgcagaaaaacattggaagatgaatacatccttaagctttgcaccgaatggcagagttgcttagtaggctgtaacggagtggcactcgttattgtgctcaagtatcgcaaaaaagctgtacttatagaggcaggaaatgtgagttttctgtaaataaaggtggtaacacgaaagtgatagactctcgtcctttttagaaaggatgagagtttttttatatcaaaaaaaggagaaaaaacaatgaaaatctatgaagaattagttgccagaggtttaattgctcaggtaacagatgaagaagaaatcagagaactggtaaacaatggaaaggcaacattttacattggatttgacccgaccgcagacagtcttcatgttggacatttcatggcattgtgtctgatgaaacgtctgcagatggcaggaaacaaaccgattgccttaatcggaggcggtaccggtatggttggagatccatccggtcgtacggatatgcgtcagatgctgacagaagaaacgattcagcataactgtgattgttttaagaaacagatgagtcgttttattgacttctcagatgacaaagcaatgatggtaaataatgcagattggctgatgaaattgaattatgttgaagtattacgagaagttggttcttgtttttctgtcaataatatgctgcgtgcagaatgctacaaacagcgtatggagaaaggattaagctttctggaatttaactacatgattatgcagagttacgacttttacatgttataccagaaatacggatgtaacatgcagtttggcggaaatgaccagtggagcaatatgcttggcggtacggaactgattcgtcgtaaattaaataaaaatgcctatgcaatgaccattaatctgctcttaaactccgaaggaaagaaaatgggaaaaacgcagtccggagctgtatggcttgatccgaataagacttctccgtttgatttctatcagtactggagaaatgtaagtgatgctgatgtattaaaatgcctgcgtatgcttacattcctgccgttagaacagattgacgaaatggataaatgggaaggaagccagttaaatcaggcaaaagaaattttagcttatgaactgaccggacttgtacacggagaagaagaggcaaagaaagcgcaggaaggtgcaagggcattattctctaaaggaaatgcaacagatatgccgacaacagaaatcgaagaggcagatttgacagaaggagaagtggacttaattacgttgcttcagaagagtaatcttgcgtctacccgttctgacggcagacgtgccatcgaacagggtggggtttccattgatggtgaaaaagtaacggacatcaaatttatggttgtaaaggaaaacttggaaggcgacggtattgttatcaaaagaggtaagaagaaatttgcaaaagtaattttaaagtaagataaaagtaagatacaaaagcaactatatttgtctttttttcagaaagaagaaaggcaaaaatggttgctttttactgtatggtgtgatagtctgatatcacaaagtaaaaggcggattgaacaaaaaacattcgcagcaaatcaacagaaatctattcattttattcagttacaaaatcaaagatgaaatctcatcgattatccacaatatagaaattttatcaaaaaaaagatactgcttctatccgcctgaaacaggaggtcatctatgaaaaaaacaggaattatttttaatggacttaaagtacgtcaaaaacaaagacaaatatgtgaagagccagaaaaaaatgccatccgtgaagaaaatgcttatgaagtcaaagaaaaagaagtctgtcttgatgtgacttattttcttacgtttgcagtggtacataatccggtatgcaaaggtaagatgaaacaattttcagttcttcagattttacattatcaaaagttattcgaagcatccaaatatcatggagagtattttttatcctgtcttggatatgaagaatattattatgcccaggtcgtgcttggaatgttgtttgaaattcgagagggcgagaaaaaagaggcaaaaaagagttatgagagtttgattgagatgataacggcaggctggtgtgaggtcagagaggaactgtttgaaagaccaagtgtaaaatttcataaaattcaagaatgggcaggtctgtatacggaacagccggcaatgggcttaagtcagctttgtattgtatatctgttggcagaagtctttcaggtgaaaattcttcctgacacaaattctgccctgttgtttcaatgtatgttagatagaaatactatttggaacagtccaaaagcagaggttatggaatatccatttcaaaatgctaaagcagaacaaaaaagtatggaatttttacgaattttaagaaaacagatgaagtatccatatcgggcaattaccggatttttaaacaaaaaagaagaagagtttgattattacctgcagaatttgttccatttaggaggaattgaccggaatgtgatttgtggagagaaaattgataaacagacatttgagattttaacggaacttggaggatttgaaaatgagcagagtttaaaagaatatgtctattctctttatattgtgttgttaagtcaatatgtgtcaaaatgtctgaattatctaaaagttcagaatccggcagtatgggaaacaaaacgaatggaaatgcaggacagggaggaaattttactaaaaaagatagcggagctggaaaaaagaagttgacaaatgaaaaaatgaggactatacttataacaaatttaagtgaatagcactttaaaccgttgaacaagaggagtaaataaagaaatccgttaaagcagagagatctgttacagagagttgtagatggtggaattacagcaatgtgaatttttattgaatggacttgtgagggcagcttgaaatttgaaaaaaagtagacgctgacgggaaatcccaaccgttatcaatggggcgtgtatgatagtacatgggaagagtggttcaggaaaacctggataatttgggtggtaccgcaggagcgagaaataaaaaggctcttgtcccattagagaaaatctaatgggacaagagccttttttaattcataagaaatttcgtcttatgaattaaaaaaacgctccgcaagaatgtgccttggtacattctttgttcttggatagaaaacatattcagaaaggatggcagatatgaaaataacaccagattgcaatacaatattaaaattagcagaagaatattcggttgttccggtctgcaaagaaatttatgcagatatcacaacaccgattactttacttagaaaaatctctgcaatttcaaaaagatattatttgttagaaagtattgaaggtggcgaaacctggggaagatattcctttctcggatatgacccgattatgcgtgtgacctgccggtcaaatgaagtggtagttgagaaaaaaggaaaacaggaaacttatcaaaccgaaaaacctctggaaatcattcgtgagattatgaaagattaccgttcaccgaaattagagggaatgccgccatttacaggagggtttgtaggttattttgcttattcgatgattggatatgcagagccggttttaaaaattaaaaaaggaacctttccggattatgatgtaatgctgtttgataaagtcattgcttatgaccatttaaaacagaaaatctgtattatcgtaaatatgaaaacagatcgggtaatggaaaattatggagaggcaactgctgaaattgcgaaaattgcagctatgattaaaaatgcatcgattccggaatttccaaaggagatagaaaatattaattttacctgtaacgtcagcaaagaggaatattgcagtgttgtagaaaaaacaaaagagtacattaaagacggcgatattttccaggcagttatttccagacagtttacaagtccaatgaaaggaagcctgttaaatgcttaccgtgtattaagaacaaccaatccatctccttatatggtatatctgcactttgatgaggaagaattgatgagtagttctccggaaactctggttcgtctgcaaaatggaagattgacaacgtttcctgtagccggttcaagaccaagaggaaagaaccgagaagaagatgaagaacttgaaagagatttattatccgatgaaaaagagttatcggaacacaatatgttagtcgacttaggaagaaatgaccttggaagaatcagtaaattcggttcagttgacgtgacaaaatacatgatgattcacagatattccaagattatgcatatctgttcacaagtggaaagtgagattgaatcattgaaagacggattagatgcaattgaagcagtacttccggcaggaacactttccggtgccccgaagattcgtgcctgtgaaattattgaagagttagaaagcgaagaaagaggaatttacggtggggcacttggatatctcgattttgcaggaaatctggatacctgcattgcaattcgaatggcagtaaagaaagacgataaagtatatgtgcaggccggaggcggtattgtagcagacagcgttccggaaaaagaatatgaagaatctgcaaataaggcagcagccgtgatgcaggcaattcaaaatgcagaggaggtagacaaagtatgattcttttaatcgacaactatgacagttttacttataacctggttcaggtaatcggaacaattaatccggatatcaaagtcatccgaaatgatgcaatgagtgtagaagagattgaaaaattaaaaccttctcatattattttatctccaggaccgggatatccaaaagatgccggtgtatgtgaagaagtggtaagaaaattacagggaaaaatcccgattttaggggtctgcctgggacatcaggcaatctgtgaagtatatggtgcaaagattactcatgcaagaaagttgatgcatggaaagaagagtcgtgtaaaaatcgaaaccgaaagtccgatttttgcaggaatggaagaagagattgatgcagccagatatcattctctgattgcaaatgaagatacgattccaggctgtctgcaggtgctttcaacagatgaaaacggtgaaattatggcagtaggacataaagaatatccggtttatggattacaattccatccggaatctattttaaccccgaagggaaaaacgatactggaaaattttttgaatataaaggcaggtaaaggagacagacttatgattaaagaagcaattcatactttgatgaatggacaagatttgtcttatgatatggcaagagaagttatggaagagatgatggatggaaccgcaacacaggctcagatggggtctttcttaactgcacttcgcatgcgtggtgagacaattgatgaaattacggcatttgcgcaggtgatgagagaaaaaggtgtaaaaatcaagccggaaagagaagtcattgatattgtaggaaccggcggagatgaagttggaacatttaacatctcgactacttctgcttttgtggtagcagctggtggtgttccggtagcaaaacatggaaaccgtagtgtttcaagcaaaagtggtgcagctgatgtattggaaaatctgggtgcaaatgtggcattagatgcaaaacaaaatgaaactatcttaaatcagacaggaatgtgctttatgtttgcaccggtttatcattcttctatgaaatatgccgcaccggtacgaaaagagatgggagaaagaacagtatttaatattttaggcccactttccaatccggcagcggcaaccatgcagttgcttggggtttatgataaaaagctggtagaaccacttgcaaaagtgcttggaaatcttggagttacaagaggtgttgcagtttgcggttcagatggacttgatgaaattaccgtaactggagaaactactgtttgtgaaattcgttttggagaaacaaaaacctatacgatctcaccggaacagtttggaataaagcgttgtgaattatcagagctgataggtggaacaccggttgaaaatgcacagattacaagagaaatcttaaccggaaaagaaagaggagcaaaaagaaatgcagtgttgttaaatgccggaatgagcctttatctcggaattgatggaattacgcttgaagaaggtgtcaagatggcagccgatttaattgacagtaagaaagcacttgcgaaattagaagagtttgtgaaagtgacaaaggaagtataaggaggagcgccgatatgattttagaccaaatagcggcagataccaggcttcgtgtggaggcaaagaagaaagagatttctttagaagaagtaaaaagagacgcacagagcatggaaaaaaatacaggatttccgtttgagacagcgttgagaaaaccggacctgagttttatctgtgaagtaaaaaaagcgtctccgtcgaagggaatcattgccgaagaatttccttatcttcagatcgcaaaagagtataatgaagcaggagcggatgcaatttcctgcctgaccgaaccgaaatattttcttggaaaagatgaatatttaaaagagattgcaaaagaagtaaagataccggttttaagaaaagactttgtagtggatgaatatcaaatttatgaagcgaaaatattaggtgcaagtgctgtacttttgatttgtgcgattttagaagaagaacagttaaaagtttatcttcaaattgcaaaagagcttggtttatctgcgcttgtagaggcacatgatgaaaaggaaatcaagcaggcagttcgtgcaggcgcgaaaattatcggagtgaataaccgaaatttaaaggatttttctgtgaatgtaggaaacagcacaaacttaagaaattttgtaccaccggaaattttatttgtggcagaaagcggaatcaaaggaccagaagagattaaagctttaagagaaaataaagttgatgcggttttgattggtgaaaccatgatgcgcagtccggataaagcaaaaatgcttcgtttcttaaaaggggaagaacaccatgaagaaagttaagatttgtggtttaagaagaaaagaagatatcttaatagtaaatcgtttgaaaccagactatgttggatttgtatttgcagacagctccagaaaagtgacaaaagaagaggcaaaagcactttcaaagcagttagaaaaagaaatttgtccggtgggagtttttgtaaatgaagaaccggagatagtcgcccaaattgcgaatgccggaatcattgacttgattcagcttcacggagaggaagacgaggcatacatacaaaaattaaaagcatttaccaataaaccaataataaaagctgtgcgggtgagaagcagagaacagattcaaaaagcagaagctctttcctgtgattatcttctgtttgatacttatatcaaaggacagtatgggggaagtggaaaaccctttgatgtctcactcataggagaggtttcaaagccatattttatcgccggcggtttaagtgaaagcaatgtggcagaaaaattgaaaaactgtgatgcatttgcagcagatgtcagcagtgcagtggagatagatgggtataaagacgaaaaaaaggtacagcagtttatagaagcagtacggaaaggataaaaaaatgagtaaaggaagatatggaaattacggaggacagtatattccggaaacattgatgaatgcagttttagaattagaggaagcatatgaaaaatatagtaaagaccttgaatttaataaagaattagatgatttattaaaaaattatgcaggtcgcccatctttattatattatgcagaaaaaatgacaaaagatttaggcggtgcaaagatttatctaaaacgagaagatttaaatcataccggttctcataaaatcaacaatgtacttggacaggtactgcttgcaaaaaaaatgggaaaaactcgtgttattgcagaaaccggagcaggacagcatggggtggcaactgcaaccgcagcagcacttatgggaatggaatgtgaaatcttcatgggaaaagaagacacggacagacaggcattaaacgtatttcgtatggaactgttaggtgcaaaagtacatgcggtgacaagcggaacagcaactcttaaggatgcagtaaatgaaactatgcgtgaatggacaaagagaatggatgatactctttatgtgcttggttcggttatgggaccacatccatttccaatgattgtgcgtgatttccagaaaattatcggaaaagaaattaaagaacagttacgagaaaaagaaggcagacttccggatgcagtgattgcctgtgtcggtggcggaagcaatgcaatgggaacattctatgaatttattccggataaaggggtaaaattaatcggatgtgaggcagcaggacatggaatcaataccgataaacatgcagcgactattgcaaaaggaagcgaaggagtatttcatggaatgaaatccttgttttgtcaggataaatatggacaaattgcaccggtatattcgatttcagcaggactggattatccgggaatcggaccggagcatgcaaatttaaatgcaaccggacgagctcagtatgttccgattacagatgatgaggcagtagatgcttttgaatatctttcaaaaacagaggggatcattccggcaatcgaaagtgctcatgctgttgcttatgcaagaaaactggcaccgacgatgggaaaagaccagattattgtagtgaccgtatccggtcgtggagataaagacgttgcagcaattgcaagatatagaggagtggaaatctatgagtaaaatagcaaaagcatttgagaacaaaaaagcatttattccgtttgtaacggcgggagacccgacacttgatgtgacagaacagttattatatgaaatgcagaaagcaggagcagacttaattgaaatcggaattccgttttcagacccgacagcagaaggaccagtcattcaggaggcaaatgaaagagcgcttgctgaaggatgcacaacggataaaatttttgatatgttgaaacgtgcaaaagaaaaaattacggttccaatggtatttttaacttatgttaatccgattttcacttatggaaaagaacgttttatgaaacaatgcgtggaaagtggaattgatggtctgattgtgccggatatgccttatgaagaaagggaagaacttgcaccggcatgtgaaaaatacggagtggacattattccgctgattgcaccgacttctcatgaaagaattaaaatgatagcaaaaaaagcacagggatacatttactgtgtttcgtctttaggtgtaaccggtgtcagaagtgaaattaagacagatattggggcaatggtaaaagcagtaagagagacaacagatgttccgtgcgcagtcggatttggaattgcgactccagaacaggcttacaagatggcaaaagtttcggatggagcaattgtgggttctgcaatcgttaaaattatagcaaaatatggaaaagacagcgttccttacgtaggagattatgttaaaagcatgaaagaagctgtagaaaaagcggataaagaaagtaaataatccagaaaataagtttaaaacagccgattctactaaaaaagagccggctgttttttcagcttgcagattaataagaaattcacaattttttagttgaaaaaaattgaaaaacaggttacaattaaaatcggcagaaattggttttgttcttcaactcattagagcgaaaaaccaaaatgtggtttctgcgcgaacaggattcactgtcaaataggtgcagaaatccgcaaataaaaatatatggagggctgatcaatgagtaatacagcacaaagcttggcaggcaaaagaattgaagctttgcttgatgagaacagttttgttgagattggcagttgtgtaacagctagaagcactgatttcaacttatctgaaaaggaaacaccatctgatggtgttattaccggttatggcgtaattgacggaagcctggtgtatgtatacagccaggatgcatccgtattaaacggaacaatcggtgagatgcatgcaaaaaaaatcgtaagactctacgaactggctatgaagacaggtgctccggttatcggtcttgtagactgtgcaggtttcagacttcaggaagcaacagatgcattaaatgcatttggtgaaatctatgcaaaacaggttgcagcttccggtgtcattcctcagattacaggaatctttggaacatgtggtggcggacttgcggttatgccaggtcttacagactttacatttatggaagagaagaaagcaaaattatttgtaaactctccaaatgcattagatggaaatgaaatttccaaatgcgatacatcaagtgccaaatatcagagcgaagaaagcggacttgcagatgtaacaggaagcgaagatgaaatcattgcaaaaatgagagaattagtttccctgcttccatcaaactacgaagataattctgcttatgtagagtgcacagatgatttaaatcgtgtatgccctgaacttgtaaactgcgcaggtgatacttctatcgcactttctcttcttgcagacaaccaggaattctttgaggtaaaagcagattatgcaaaagatatggttgttggatttatccgtttaaacggagcaactgtaggatgtgttgcaaatcgcagtgaagtttacaatgcagaaggagaaaaagcagagacatttgataatgtattatcagtaagaggatgcaaaaaagcagctgatttcgtgaaattctgtgacgcttttgaacttccggtactgactctgacaaatgtaaaaggctataaagcgacaaaatgttccgaagcgaatattgcaaaagcagcagcatctttaacttatgcatttgcaaacgcaactgtaccgaaagtaaatgttgtagttggagaagcatttggaagtgcttacctgacgatgaacagcaaatcaacaggagcagacatggtatttgcttggccggaatctcagattggtatgatggatgcaaagctcgctgcaaaaattatgtacgcagacagtgatgcagcaacaatcaatgaaaaagctgcagaatacgcacagcttcagtcaagtgcactttctgctgcaaagagaggctatgttgatacaatcatcgagccggaagatacaagaaaatatgtgattggtgcttttgaaatgttattcacaaaaagagaaaatcgtccaagtaaaaaacacggcacggtttaagcgaggtgaattaatatgaagcagacatggaaaaaaatcattggactgattctgattagcgtatgtatcttggcaatgaccgcttgtggaaagaacagtagtgaagaaacaagctctcttacgatgccggatgaagcatctcagcagtccttaatcgagagttttggaactgtactccagaatatttctcagttggatgaagcaagcattaaaagctatatggaaggcgatgatgcatttagtgcagcggcagcttctgcttgggataccagcggttcttctttaggaagttttgaagaagttaaagatggtaaaatggaaatcgacgatgacacttatgtagttactattgatgcaaagtttgaaaatcgtgatgcagattgtgtgtttatacttgataaaaatggaactcctaccagtgtcagcattgaccctgtttacagcatgggtgaaaaaatggcacaggcaggtcagaataccgttatgggtatcggaatcgtatttatcatgcttatcttcttaagtttcctgatttctcttatgagatttatcccgaaactggaagcagctttatcaaagaaaaacaaagcaccagaacaggcaaaaccggcaccggttgttgctgttccggaagtagaagaggaagaagtaattgatgatggcgaactgattgcagttatcgcagcagcaattgcggcatctgagaatacatcgacggacagctttgttgttcgttcaatcagaaagtcaaaaaaaggaaattggcacagagcctaatcacaggaggaaatgattatgaaatcttatacaatcacagtaaatggcgttgcttatgatgtaacagtagaagaaggcgctggaaacgctgtagcagcatctgctccgaaagcagcaccaaaggcagcaccaaaagcagcacctgcaaaagcagcagctccggcatccgctggttctgtaacagttgcagcatctgcagcaggtaaaatcgtaaaaatcgaagcaagcgtaggtcaggcagtaaaagctggagacagtattgtagttctggaagctatgaaaatggaaattccggttgttgctccacaggacggaaccattgcaagtattgacgtagcagttggtgatgcagttgaaaacggtagtacactggcaactatgaactaaaaatttgcaaatagagtgatttatttgtaagtttgcggtcgtagatagaaatctgcgaaaaatacagacaatgggaggtaataaaatgtctagcataacagatacattgtccaatctgcttggtcagacagcgtttttgaatctgacatggggaaactatctgatgattctggttgcttttgttttcttatatctggcaatcagacatggatttgaaccgctgcttttagtaccaatcgcatttggtatgctgttagttaatatctatccggatattatgtcacagccatatacggatgcagccggtattgaacatgcaggtggacttcttcactatttctatttgatggatgaatggagtattcttccgtcactgattttcatgggtgtaggtgccatgacagactttggtccgctgattgcgaatccgaagagtttccttttgggagcagcagcacagcttggtatctatatggcgtatttccttgcaatctttatgggattcaatggaaaagcagcagcagcaatctctatcatcggtggtgccgatggcccgacttctatcttccttgcaggtaagcttggacagacagcattaatgggaccgattgcggtggcggcgtattcttatatgtcactggttccaattatccagcctccaattatgaagttattcacaacagaaaaagaacgtaaaattaaaatggaacagcttcgtccggtatccaaactggaaaaaatcctgttcccggttatcattacagttgttgtttgtctgattttaccatctacagctccgttaattggtatgcttatgcttggtaaccttttccgtgaatgtggcgttgtaaaacagttaacagaaacagcatctaatgctttaatgtacatcgtagttatccttctcggaacatccgtaggtgcatctacaagtgcagaagcgttcctgaaactggatactttaaaaattgttgctttaggtctggtagcatttgcagttggtacagccggtggtgttcttcttggtaaagttatgtgtaaactgacacatggaaagattaatccgctgattggttctgctggtgtatccgcagttcctatggcagcccgtgtatctcagaaagttggtgcagaagcagacccgactaacttcctgctgatgcatgcaatgggaccaaacgttgccggtgttatcggtacagccgtagctgctggtacattcatggcaatctttggtgtataattgaaggaggaaaattaagatggcagatgtggtaaaaaaaccaattaaaattacagaaacaattctgcgtgatgcgcatcagtctctgattgcaacaagaatgacaacagagcagatgctgccaatcgtagataaaatggataaagtcggttatcattccgtagaatgctggggtggtgcaacatttgatgcatctcttcgtttcttaaaagaagacccatgggaaagacttcgtaaattccgtgatggttttaaaaatacaaaactgcagatgttattccgtggacagaatatccttggataccgtccttacgcagatgatgtagtagaatacttcgtacagaaatcaattgcaaacggtattgatattatccgtatttttgactgtatgaacgatatcagaaacttaaaaacagcagtttctgcagcaaacaaagaaaaaggtcatgcacaggttgcgctgtcttatactttaggtgatgcttatactttagaatactggacagaaatggctaaaaaaattgaagatatgggtgcaaattctatctgtattaaagatatggctggtcttctgcttccttataaagcaactgaactggtaactgctttaaaagaaacagtagatattccgattcagcttcatacacactatacttccggtgttgcttctatgacttacttaaaagcagtagaggcaggtgtggatgtgattgatacagcaatgtctccattcgctctgggtacttcccagccggcaactgaagttatggtagaaacatttaagggaactccttatgatacaggatttgaccagaaactgttatctgaaatcgctgattacttccgtccaatccgtgacgaagcacttgacagcggactgctcaatccgaagaaccttggtgttaacattaagactctgttatatcaggtaccgggcggtatgctttctaacctgacttctcagttaaaagaacagggtgcagaagataaattctacgatgtattggaagaagttccaagagtacgtaaagaccttggtgaatgcccgcttgttactccttcttctcagattgttggtacacaggctgtattcaatgttgttctgggtgaacgttacaagatggttacaaaagaaacaaaagatgtattaagcggaaaatacggtgcaactgcaaaaccgttcaacaaagaagtacagaaaaaatgcatcggtaatacaaaaccgattacctgtcgtccggctgacttaattccggctgagttagacactcttagaggagaaatggcacagtggtctgagcaggaagaagatgtattaacttacgcattattcccacaggtcgcaacagaattctttaaatacagagaagctcaggaaacaaaagtagatccgaaaatggcagacacaaaaaatggagcttatccggtataaataagattaaattttccgaaggcgaatcgtatggaaatacggttcgtctttttgttttaggcataaaatcattttgtgtttagtaaaattcagatgaaaaataattaagttcgtgttataatataaacttaatgaaagcattactatagaatgttttaagacaggaaaagaggttaaggggtaaagtatggggacggaagagaacttacttagcaggatgaatacacagtatcataaatttagcaaaggtcagaaaaaattagtatcgtatattacggacaattatgataaggctgctttttttacggctgcaaagttaggagaaacggttggagtaagtgagtcaacagtcgttcgtttcgcaattcatttaggatataaaggatatccggagtttcaaaaggcactggaagagttggtgaggaacaagttaaattcaattcagagaatggaagtgacttatggaagagttccacagtctgaaattttagatacggtacttcgagccgatattgaaaaaatcaagctgacaatggaaaatatagaccataatgcgtttgaacttgcagtggagaccattcttgaggcaaagagtatttatattgtaggaatccgcagttgtgcaccactggcaagctttttgggattttattttaatttattatttgataatgtacatttgatgcatacaaacagttcaagtgaattatttgaacagatgattcacatcagcaaggacgatgtgattattggaattagttttccaaggtattcgatgcgtacattaaaagcgcttgagtttgcaaataatagaaatgcaaaagtaattacattgacagacagcattcattcaccaatgaacttatattcttcttgtaacttgattgcgagaagtgatatggcgtcaattgtagattcacttgttgcacctttgagtgtgattaatgcgttagtagtcgcactttgtatgcgcaaacaaaaagaggtgactgctacgttagaagatttggaaaaaatttgggatgaatatcaggtgtataataatgatgaaattaatcttgcggatgggaaagaaattgaaattcgtaatccggatgagttagaagattaaaaggagtgtttcatgacaaaaatagcaatcatcggtggcggtgctgccggaatgtatgcttctgtttttcttgccgaaaagggacacgaagtacatgtatttgaaaaaaatgaaaaacttggaaaaaaattatttattacgggaaagggtcggtgcaatgtaaccaatgactgtgatgaagagacatttttttccagtgtgattaccaattcaaaatttttgtatagttcttattatggatgcacaagtcaaaatgtaatggatttctttacctcaattggggtaaaactaaagacagaacgtggaaaccgggtatttccggcttcagaccattcttcagatattattcgggcattagaacataaaatgagagaaacaaaggttcagattcatctaagaacagaggtaaccgatattttatctgaagaggactgtatcaaatatgttgtgactgcaaagggaaaagaagcctttgataaagtaatcgttgcaacgggcggatattcttatcaggcaacgggttcgacaggagatggatatcgttttgcagaaaataccggacatagtgtgacaaaaatccgaccggcattagttccactaaaggtaaaggaagattatatcacaaaacttcagggactggctttaaaaaatgtacagctgaccatcaaagaccagaaaaagaaattgtatgaagagtttggagagttgttgtttactcattttggagtgtcgggtccgcttgttttgacagcaagttcaaagattggaaaacagcttgaaaaaaaaggcagtcttttagctgaaattgatttaaagccggcagtttcaaaagaacagctcgatgcaagaattttaagagagtttgaaacagttaagaataagcagtttaaaaacgcaattggaggtctgtttccggcaaaattagaaccggttatgatagaaatttctaagatttcgccggaaaaaaaggtcaatgaaattacaaaagaagaaagaagaagatttattgatttaatcaaagcatttccatttacgattacaggaatgcgtgactttaatgaggcaattatcacacagggcggagtaaagacaaaagaaataaatccgtctacaatggagtcaaaaaaggtaaaaaatttatattttattggagaagtgcttgatttggatgcagtaacaggtggatttaatcttcagattgcctgggcgactgcttactgcgcagtaaacgcaatttgtatggaagaataaaaaacaagaattggatgagataaagttaagatagataaaggagagaaaaaatggcatttagtattgcaatagatggaccggcaggggccggaaaaagtacaatcgcaaaggaactggcaaaacgcctttcatttgtttatgtagatactggtgcgatgtaccgtgcaatcggattgtatctgcttagaaatcagatttcaccaaaagatgaaagttctgtggaaaaagcatgtaaagaaattcagatatccatttcttatgaggatggggttcagcaggtctttttaaacggagaaaatgtaagcgaagaaattcgaaaagaagaagtaggaaatatggcttcggcaggtgcaaagaaccggaaagtccgcgaaaaactggtagagcttcaaagagaactggcttctaaggctgatgttgtaatggacggaagagatattggaacctgtgttttgccaaatgcgaatgtaaagatttatctgactgccagtgtgcatacaagagcagtgcgtcgttatcaggaatatcttgcaaaaggtgagaaaataacattagaagaagtggaaaaggacattgaaaacagagattatcaggatatgaatcgtgcgatttctccgcttaaacaggcagaggatgcagtatttttggattcttctgatatgggaatcgaggaagtattagagacaatgatttccgtttatgaaaaaagtaaataaaaaagaggtttaaaaagtggaagtaaaagtagcaaagacggcgggtttttgttttggcgtcaagcgggcagtagaaaaagcttatgaggttgctgaaaaagaacaaaaagatgtttatacttacggaccaattattcataatgaagaggtagtaaatgatttagcccaaaaaggagtccatgtcattgaaacagaagaggatttaaaaaagctgcaaaatggtattgtagttatccgttcccacggagttccaaaaagaatatattccctgcttgaagaaaaagaaattgagtatgtggatgttacctgcccgtttgtcttaaagatacaccggattgtggaaagagaaagtaaagccggacggcatattgtaattattggaaatgaggcacatcctgaagtagagggaattcgtggctggtgtgaaggagaatctactgtgataaaaacaaaagagcaggcagaaaaatttctggaatcaccacccgaaaaggtgtgtatcgtctctcagacgacatttaattacaagaattttcaagaattagttgaaattttagccaaaaagaggtatgataaacttgttttaaatacaatttgcaatgcaactagtgagcgacaggccgaagctgcagaaattgcaaagacagtagacgccatggttgtcattggaggcaggcatagctcaaacacacaaaagctgtatgagatatgcagtggcgaatgtaaaaacacctactatatacagacacttgctgacttggattctgatagttttcaatccattcaatgtgttggtattacagccggggcgtcaaccccaaataaaataattgaggaggtttcaaaacatgtcagaattaagttttgaacagatgttagacgaatcatttaaaacaatcagaaacggagaggtagtggaaggtactgtcatcggcgtaaaagaagatgaaatcatcttaaatatcggatacaaagcagatggtattatttcaagaaatgaatattcaaacgattccaatcttgaccttactacagttgtatctgtaggcgacacaatggaagcaaaagtcctcaaagtaaatgatggagaaggacaggttcttcttacttacaagagactggctgctgaaaaaggaaataagagactggaagaagcttttgaaaataaagaagtattaacagcaaaagtaactcaggtattagatggcggtttaagcgtactggtagaagatacaagagtatttattccggcaagcctcgtatctgattcttatgaaaaagatttaacaaaatatcaggaccaggaaattgaatttgtaatcacagaatttaatccaagacgtcgtcgtattattggtgaccgtaaacagcttttagttgctaaaaaagcagaaatgcagaaagaactgtttgcaagaatcaaaccgggcgatgttgtagaaggaacaatcaaaaatgtaacagactttggtgcattcatcgatttaggtggagcagatggtcttcttcatatttctgaaatgtcctggggcagagtagaaaatccgaagaaagtattcaaagccggagatccaatcaaagtattaatcaaagatatcaacggagataaaattgctctcagccttaaatttgaagaccagaatccttggttacatgcagctgaaaaatatgcagctggtaatgtagtagaaggaaaaattgcacgtatgacagattttggtgcatttatcgagttagaaccgggtgtagatgcattgcttcatgtatctcagatttccagagcacatgttgaaaaaccatctgatgtactttctgtaggacaggttgtaactgcaaaagttgtagacttcaacggagaagaaaagaaaatcagcctgagcatgaaagtattagaaccggcagcagaagagacagcagaaacaacagaagaataataaaataataaaaatgtaacaacgagaaaaaaacggctgcttagaggcagtcgttttttatttttctatttctttggaagattttttaaaaattctcttaaaaattcctgctgcatttcgggtgaagtagaaaattctgaagtccactgaatataaatttctttactctcataatcggtcttaaattgagaaagatttggattaccataagcacgcagaaaaaatccggaaatctttttatagcagttggaagcttttgccttttgacggcaggacgaatcgacataagaagcaatggatttatgaaccgcttcatcctcaagaggaagataataataatttttataatttttgtagaagtatcttaatgttccagataaaagaggcagttttaattttcccgtatgcccggagaaagtgagagagaacatttctaagtgataagaaaaatcagtcggaagaacagatggcagtgaaaattgaaataaaatatctgtgcggatatcgccatttaaagttgtgctttttaaaatatgactttgaatgaattcaaatttaccatttaggacagcttttaaaatatcaagagagagcagatggaacattccttctatatcatcatggttatgaaggagaagcaggttttgatcctcttttttatgcagagaagcaaaggaatgaaagacctgaattaattgttttccgtccatggtatcaagtctttgataatggcagagaggttccagtgttctctgtttaaaatcagaaaccggaagtaaaaatgaaattggacgcagagtccgatataaatcgatagatttcattgaaagaagaggggatgaaacctgatattgtgtggacttatgaagtaaatatgggatatcaaaagtagttccattaaaatgaatcagacagtcacggtctgagcaaagcttataaaaggactgtaaaagtgctgtctcttcttcggaagtttcatgttcagccagaaattgataaagtttgaacgaagttttttcaaagactgcagctccaattaggtaaagatgactggttttatggcttaatccagtcgtttcaatatcgaaaaatagagttcgttcttttgaaatggaatttttttggaaaaaatgatctatgcaattataataaaaatttgaataaaaactagctattgttaacatattaacaaacatcctttcgatatgtactaaaaataatacgaaaaatttactaaattttatagagaaattacaaaaaaaatgttatattattataagagagcaaaaaggaggtaatatggaagttaaaattgcgggagtctctttgtattatatcataaactggttttttatctacagctttctgggatgggtgtgggaatcctgttacgtgtccgcaaaagcaaaaaagataataaacagaggttttataaatggtccattgtgtaccatttatgggttcggagcaatcagtgtatatttaatcttgaaagattttgacgaaaatatactgattttgtatttcggtggagtgattgttgcaacggtgttagagtacataacaggctggctgatggaagcgatttttcatacccgatggtgggattacagtaaaaagccatttaatcttcagggatatatctgtctggggtcatccattgcctggggtgcatttacggtgttactgttttatgtatttcagccgtttgtggaatggattacaggactttatcctgtgtctgtgggaaaagttggaatttccattgtaagtgtgttatatgcagttgactttggaagttctgcagtaacagcgttcaatttaagcaaagcctttggaaaagtggaagatatgctggaggatttaagtggttatcttcatacaaccaaattatatgagacaaaagaggaagttcgtgagaaactggatgaattacgtgtgataaatgcatcagaactggcagagcgcattgcagagaagaaagcagaattttcatcacagcttgagaaaaaacagctgcaattgccggaaacttatgaaggaatgcgtgcagaactggaaaaacgcatggatgaatttaaagaaaaatatatcacgattcgtaaagagaccaatcctgttagaaaacgtatgatacaggcgtatcccggattgaagactgaattcagacatcatttagaaagaaagtctggaaaaagacatgaaaaacgaatttcaaagtaaaggaggaactatatatggcgtttttaacctttaggggtggagtacatccttatgacggaaaagaactgtcaaaagaaaaacccataacggactatgctccgggaaaagagctggtttatccattatcccagcacattggtgctccggcaaaaccggtcgttaagaaaggagaccatgttttggcggggcagatgattgcggaggcgggcggatttgtatctgcaccgattcatgcatctgtttcaggaacagtgactggaattaaaaaaattctcaataatatgggaagcaaagtagatgcgattattattgaaaatgatgagcaatatgaaagtgtaccggatcaggtgacggagtctcttgattcactttcaaaagaagaagttttaaataaaatccgcgagggcggagtagttggtatgggtggagcaggttttccgactcatgtaaagctttctccaaaagagccggataaaattgaatatgtactggtaaatggagccgaatgtgaaccatatctgacttctgattaccgtcgtatgatggattatccagatgaattaatcggtggattgaaatgcatgttgaaattatttgataatgcaaaaggctgtatctgtatcgaggataataagccggattgtattgcaaagatgacagagttagtaaaagatgaaccgagaattgaagtaaaaacattaaaaacaaaatacccgcagggtgcagagcgttgtctgatttatgcagtgacagacagagagattaactcttctatgcttccggcagacgcaggatgtgtggtagataatgtcgatacggtatgtgctgtttatcgtgcagttatgtttggacgtccggttactgaaaaaatcgtaacagtaaccggtgatggaatcgcaaatccgcagaatttccgtgtaaaaatcggaaccagttttgcggatctgattgaagcggcaggcggattaaacgagccggtagaaaaggttatctctggtggtccgatgatgggatttgccatgtatgactaccatgttccgattgtaaaaacttcttctgctattttatgtttaaagaaagatgaagtaacagcagtagaagcaacagcgtgcattaactgtggtcgttgtgtcagtgcgtgtccggcaagactggtaccgtcaagactggcgacttattcagaacatggacaggaagaacagtttgtaaaacataatggactggaatgtgtagaatgtggatgttgtagttttgtctgtccggcaaaacgtcatctgactcagtctgtacgttctatgagaaagatggttcttgcaaaccgtaaaaaggcaaaataggaggagaaaaagatgagtgattttctgcatgtatcatcttcgcctcatgtaaggtcgaaggtgagcacggacggcataatgaaaacagtattacttgcattgctgcctaccacattatttggaatttataattttggtttgcatgcactgcttttaattctggtttgtatggcgacctgcgtggcaacagaagccgtttatgaaaaaattgtaaataaaaaaagtacaataaaggattgcagtgcactggtaaccggtttgttgctggctctgaatcttccaccaaaagctccgtggtggattgctgttgtaggtggtatttttgctatcttaattgtaaaacagctctttggaggtctgggacagaactttatgaacccggcgcttgcagcaagatgttttctgttaatttcctttaccggaagaatgacagattttacggtaccggatggcgcatttggaaaagtggtagatacggtatctggtgcaactccactggcagcggtaaaagccggtgaaagtgtaaatctgatgagcctgtttatcggtaatacaaaaggtacaatcggtgagacatccgcactcgcaattttaattggtgcagcaatcctgcttgcaacaaaagtaattgatttgcgtgttccgcttacttacattggaacatttgcagtttttgcactgttatttggcggacatggatttagcatcagctatcttgcagcagagctgtttggtggtggcttgatgttaggtgcatggtttatggcaacagattatgttaccaccccaattacgaaaaacggacagctggtttatggtgtgtgtctgggtatctttaccggaattttccgtatttttggcggttcagcagaaggagtttcttatgcgattatcttctgtaacctgttagtaccgttgattgaaagagtaactatgccggttgcttttggaaaaggaggtaagaaatcatgaaaaaagattcgattgtaagagatacgttgattcttaccgtaatcacattgattgcaggtctgcttcttggactggtttaccagattacaaaagagccgattgcacagcaggaagaaagtgcaaaaacagaagcatataaagccgtttttgcagaagcagattcctttgagccaattgtggaagcagaagatgctgacctttccgcttatctggaacagaatggtttttcccagagtattaatgagatcatggaagcaaaagatgcgagtggagaagtgttaggttatgcaattaatattacgactccggaaggatatggcggagatatcactttttcactgggtgttaaaaatgatggaacgttaaatggaattgaaattttaagcatcagtgaaactgccggtcttggtatgaatgcaacaaaagatgactttaaaaaccagtttaaagacaaaaaagcggaagaatttaaagtgacaaagaccggtgcacagtccgaagatgaaattgatgcattaagtggtgcgaccattacttcaagagcaatggttggaggcgtaaacgcaggtctttgcgcatttcgatatgtagaggagggagaataggatgaaacagaatacacctgttgagcgtttgtataacggtatcataaaggaaaatcctacctttgtcctggtacttggtatgtgtccgacacttgcggttacaacagcagctatcaatggtatcggcatgggacttacaactacggtagtacttatgatgtcgaacttatttatatcacttcttagaaatgtaattccggataaggtacgtatgccggcttatattgttattgttgcatcttttgttacaatggttcagcttttacttcagggttttattccatctttgtatgatgcacttggaatttacattcctctgattgtagtaaactgtattatcttaggaagggcagaagcttatgcttctaaaaatcctccgattccatctttatttgatggtatgggaatgggacttggatttaccttatccattacaattcttgcagcgttccgtgaattaatcggagctggaaccgtatttggagttcaggtaatgccgaaggcttacgaaccggcaaccatttttattttagcaccgggagcattctttgtgcttgcatttttggcagcgattcgtgcaaaattacaggataagaaacccgaaggagaaagacacgaaatccattgcatggaaggtgcttgtgcttcctgtggtaataaatcctgtcataaacagtaaaggaggaaaggcgcaatgaaagaattacttattatcggaatcagcgcagcgattgtaaataatgtcgtgctgagtcagttccttggactgtgccctttcttcggcgtatccaagaaaatagaaacagcagcaggtatgggcggagcagttatcttcgttattaccttatcatcttttgtgacaagtttgatttataaatacatactggcaaatccgcatgttaatatgcagtttttacagactatcgtatttattcttgtaattgcagctttagtacagtttgtagaaatgtttcttaagaaatctatgccggcactctatcagagtctgggtgtatatcttccattaattacaacaaactgtgcggtacttggtgttgcagttatcaacgtacagaaagagtataatgtacttcagggaacggtaaatggttttgcaactgctcttggttttacaatttcaattgtactgatggcaggacttcgagaaaaaatggaatacaacgatgtaccaaaatatttccagggattcccgattgtattattgacagccggtttaatggccattgcattctttggcttttctggcgtaatctaaggaggcacggagtatgattacaggtattgtaattgcagcagttttagtaggtggcgtgggcctctttatcggagtgttccttggactggccggaaagaaatttgctgtagaagtagatgaaaaagaagttgcggtaagagaacagcttcctggaaataactgtggcggatgtggttacccaggatgtgatggtcttgcagcggcaattgcaaaaggagaagctccggtcaatgcatgtccggtcggcggagcaccggttgcagcgaaaatagcggctgtaatgggagaagaagtaggagaaaccgttcgtacaagtgcgtttgtaaaatgtcttggagattgtgaaaaaacgacttctctttatgaatatgcaggtgaagaagattgtaaaatggcagctttgatgcagagcggtggtaaaaaatcctgtggatttggctgtcttggttatggaaactgtgtgaaagtgtgtccgtttgatgcaattcatatcataaatgggattgcaaaagtggatcaggaaaaatgtaaatcctgcggaaaatgtgttgcagagtgtccgaaacatctgattgaaatcatcccttatggacagcatcaggttggatgcagttccaaggaaaaaggaaaagaggtcatgggagcctgtaaagtgggctgtatcggatgtaagaaatgtgaaaaagaatgtccggcaggagcaatcacagttacagataatgtagctcatattgataaagaaaaatgtacgaattgcggtaaatgcaaagaagtatgtcctagaaaagtaattgcataaaatgagtccaaagagccaaaatgcgaacatatatttgcattttggctctctttatgttagaatggaaaaatgaaaataaataaaaaagatatgatattaattggaggagtattactgctcgctttgattttctggttgattccttttataaatcagaagagagattctcttcaaaaagaagaacagcaggggatgctcaaaattacggtggatggaaaacagtatggtacatattcactttcaaaaaaccggacaatagaaatcaatgatacaaatatctgcgaaataaaggatggaaaggtgacaatgacagaagcagactgtccggacaagttatgtattcatcaaaaagcgatttctacaaagggaggaacaatagtgtgtttgccaaacaaagtggtattggaaatcgagagcagtgaaaaaccagatagtattacttattaagaaaaataagatattggatttagagagaatgaatgagataataataaaaaagacagcatatttaggcatattttctgcaattgcaattatatttggctatgtagaatctttatttcctcttggaatccctggagtgaaactggggcttgcaaatcttgtaattgtttttttgctttatttatatggggtaaaagaagctgttgcggtttcctttgtgcgtattctggtcattggttttttgtttggaaatctgttttctatattatttagccttgcaggcgcagtggtgagtcttggacttatggtgattttaaaaaagacaaaatggttctctgtagttggagtcagtgttgccggaggtgtctcacataatattgctcagattattgtagcgtcttttgttgtaggaaatttaaatctgttttggtatcttccggtattattggtatctggtgttatagcaggatttttgatgggaacgttagcaacggaagtattaaatagaatacagcttaaaaaggacagaacgggaaaggacagaatatgattgcttatataaaaggtgaagttgcctggatagaagaagaacgaatcgttttagagtctgggaatattggatataatattatgatgccggcatcttcttttgatacacaagatttagtgggaaaagaagttaagatttatacgcatttgaatgtaagggaagatgcaatgcagttgtatggatttttgaatttagatgaattaaaaacttttcgtctgctgttaggagtcaatggaatcggtccgaaagcagcacttgggattttatcgggtcttacgacagatgaacttcgttttgctgtgctttcagatgatgtaaaaacgatttcaaaagcacctggaattggaaagaagacggcacagaaattaattttagaattaaaagataaaattgatttggaagaggtatttgagacaaaacaggagcatgccagagaaacagaaggaaagatggaaagtaaagaagagaatgctgcaaaaaaagatgcagtcgatgcattgacagcgcttggatattcgagtacagaagcactgcgtgcagtccgtcagaccggggtgacaccggatatggatgtggaaacaattttgaaattagcgttaaaaaatatgaatttgtagtgggaaaagaagatggaaagaagaatcataacaacagatgtgatagaagaggacttaaagacagagggaaatcttcgaccacagctcttagtcgattatattggtcaggaaaaagcaaaagaaaatctgaaagtttatatcgaggctgcaaaacagagaaatgatgcattggaccatgttcttttttatggtcctccaggacttggaaagacaacgcttgccgggattattgcaaatgaaatgggagttcatttaaaagtaacaagtggtccggcgattgaaaaaccaggagaaatggcagcaattttgaataatcttcaggaacatgatgtattgtttgtcgatgaaattcaccggttaaaccggcaggtagaagaagtcttatatcctgctatggaagattatgccattgatattatgattggaaagggaacttctgcaaggtcgattcgtctggaacttccaaaatttacgctggtgggagcaacaacccgtgccggaatgttgactgcaccgcttcgtgaccgttttggagtggtacatcatcttgaatactatacagaaaatgaattaaaaacaattattatccgttctgcaaaagtgcttggagtagagattgatgaagaaggtgctatggagatggcaagacgatcaagaggaactccacgtttggcaaatcggctgctaaagagagtgagagattttgcacaggtgcgttatgatggaaaaatcacaaaagaagttgcggattttgcattgaatttattagaagtagaccgatatggattagaccagattgaccgtagaattttaagtacgattatggtacagttttcaggaggaccggtcggacttgatacacttgcagcggcaatcggagaagattccggaacaattgaggatgtatatgaaccatatctgattaaaaatggttttcttgtgcgaacaccgagaggtcgtgtagcaggcgattttgcttatgaacatttggggattgacagaaaatcttaaataagagccaaaagaaaaggttgtttttctctgtatttcgattataatagacagtgaaagaataagcaaaagaaaaatcgggaggaccctatatggcagtgaaaaatacaacgcaggttttgatcggaggtaagataatgaccttaagtggttatgaaagcgaagaatacctgcagaaggttgcatattacataaataataaaatgaccgagctgggtcagcttccaggttacagccgtcagtctcttgaaaccaaacatacgctgttggatttaaatgttgcagatgattattttaaggcaaaacgtcaggcagaattgtttgaagaagaactggaaacaaaagacagagaaagctatgaattaaaacatgatttgattacgtctcaggttcggctggaaaatgcagaaaaagaaattgcattaaaaatggaacaaatggaaaaattacaaaagaagatagaagagttggaaaaggaacttggcgggcgtcttaaaaaataagcagctgcaaaagattccgaaattgagagggcgcgcttcgaaagagggacacgccctttttctgtcataaaatctatagtggaaagttgatttgagtcagttaagcggatgtttggcttgtaattcatttttgggcttgatttggttaaatgattaaaagttgaatgacaggaaagaatcggaaaataagaaaggaatgaaaatttttatgaaattagagttactggcacctgccggttcgatagaaggaatgagagctgcaatagcagccggagcggatgccgtttatatgggaggagagttatttggggcaagagcttacgcaaataatcccgaggaggaaggattaaaagaagccattgattatgtgcatctccacaaaaagaaactgtatctgaccgtaaatacgttgttaaaaaataaagaattaaaaacacagctttatgattatattgcacctttttatgaacagggattggatgcagtgattgttcaggattttggggtacttacttttttaaaaaaagaatttcccaaactgcctttacatgcaagtacacagatggcagttaccggagcagaaggagcaagactgttaaagaaatttggagtttcaagagtcgtaacagcaagggaactttcgctttcggagataaaagaaatcgatgagcagacaggagtagaaattgaaagttttattcatggagctttgtgttacagttattcaggaatgtgtctgttttcaagtatgttagggggaagaagcggaaatcgtggacgctgtgcccagccctgccgacttccttataaggtggaatgttatggaaaaaaaacaggcagccaaaaagaggaatatccgttaagcctgaaagatatgtgtacgattgaactgcttcctgaaattttaaatgcgggagtgtactctcttaagatagaggggcgcatgaaaaaaccggagtatgcagcaggagtgacccgaatttatcgaaaatatctggatttatatgagaaaaatccagcatcctatcatgtagaaaaaagtgattttgaagaattactggaactgtatcaaagagatggatttagtcagggatattataggcagcataatggaaggaatatggtggcacttgaaaatttaaaacagcagaagaaagaaaaaggagtatgtcaaagagatgaagcactttttcatacattaaagaaagagtacacagaaaaaaaacttcaggaaaaaataaatggaactttaatgctgtatacgggagcaccggcaattttagatttggaatatgataagattcgggtgtcagtcgagggtgacagattcgagatggcgcaaaatcaggcactgacacaagaacgcatcagaaaacagatgatgaaaaccggaaatacaccgttttgttttgaaaatctggaaattcagacagatgaacagggatttcttccgatgcaaagtttgaatgagctgagaagaaaagggctttctttgttaaaagagcaatatcttaacagttttaaacgtacacttcctgaaaaaacaggagagcagaacaataattatgcagaatcaaaatcatcagagttagaaacttcagaagaaatttattattatgcatcagttgaaaccagggaacagctgtctgcggtactcgagcgtccagaaataacgggagtttattttgacagtacattggtgtggggaaactcagtagagcagaaattagatcagatagtcgaaaggattcataaaaagaaaaaagaagcctatctgatgcttccttatatattaagaaaagagaaaacagaccagataagaaaattaattgagtatagtgcagaacgtctggagggatttttgattcgcaacgtagaggaactggggttacttgaaaaaatggggctcttaaatcaggcagtctgcgattttagtctttatacgatgaatgatgagtcgaaatgcttttttgataaaaaaggagtcaaaagaaccacgattcctcttgaattaaatgagagcgaaatcaaaaagagagagaacagtgacagcgaaatgattatttatggatattatccgatgatgatttcggcacagtgtttaaaaaagacctgtgagcgttgcgaaaagaaagcagatattgtaacattgacagaccgatacaagagcagattccgaacaaaaaccgtctgtgatttttgctataatgtaatttataacagtattcctaccggttttcttcaggaagaagaaaagataaaaaaacttggaataaaaaatctgagaatcagtctgacaacagagagaaaacaggagtcaaaagaactgcttgagttgtttcttggagtttacaaaaataaaaaaaacgtgccgaaaaatgttttagaatttacaaagggacattttaagcgtggagtagagtaggtgaaaatttgattaatttgattgttacactttctaaatatttacttttgattttaattgcactttatactttagagagttttattgtttttggatatcgttatgaggaagataagagatatatcttgaagaaacagctgatgcttatctttttcatggattttatggcatttcttgtaatttttttgaaaaagcaggaattggaaattatttatttttttatagtacagttattgtattttattgcggttcagattttatatcggattttttataaaaattcatctctgcttttactgaatcatacctgtatgttactgtcaattggttttattatgttggcgagactggatatggaatcagcagtgcgtcagtttgagattgtagttattgccacaatcattgcgatggtgataccggttatgattcataaattccggttcttaaataaatggacctggttttatgcggtggtaggacttttgctcttgcttactgtgctggtgcttggaaaaaatgtaaatggggcaaaaatcaatatttcctttgggggatttgcgtttcagccatctgaattcgtgaagattatctttgtgttttttgtagcatgcagattgtataagaaaaagacggagtttcgggattatgtgattacaacagcaatcgcagcggtttatgtgttgattttagtgttatcaagagacttgggaagtgcggttgtattttttattacttatgtggtaatgctttatgtagcgacaaaaaaaccgctttatctgtttgcaggactgggatctggttctcttgcagcagtagtagcatactttttattcagccatgtaaggcaaagggtgatcgcctggaaagacccgttttctgtttatcaaagttccggttatcagattgttcaggggttatttgcaatcggaacaggaggatggtttggaatggggctttgccagggctcaccgaatatgattccgtttgtaaaacaggactatatgtttgcggcaatttgtgaagaattgggtggattgtttgcaatgtgtctgattttaatctgtatgagcctgtttgttttagtagtgaatatctcactgcagattaaacgaccgttttataaactgattgcccttggacttggaacagaatatgcatttcaggtgtttttgacaattggaggtgtaacaaagtttattccaatgacaggaattacacttccgttagtcagctatggtggaagctctgttcttagtacgattattatgttggcaattattcagggattgtatattttaagagaagatgaggatgatgaacttgagagacagaagagatgagcagcgcagatggcaagacgagaagcgcagagaacagcaggcgaagctcacagaaagaagagcacgagaggctaagaaaatacgaaatcgagaatatacgatagtaagttacttttttgtttgtatttttatttcattggttgtctatatggtatattttgaattggaaaaaaaagacagtattatcaacagtccgtataatacaagacaggatcagtttgaagaccgtgttgtgcggggaagtattttatcggcagatggacagacgcttgcgtatacacaggtcaatgaagatgagacagagacaagaatttatccgtttaataatctgtttgcacacattgtcggatatgattcaaatggaaaaaacggcctggaatctctggcaaactttgagctgatgacatctcatgacggctatgtcaagcaggtcaaaaatgaaatgcaggagacgaagaatcagggagataatgtggtaacaaccttaaacacttctcttcagcagaccgcttatgatgcgctgggagacaatcagggagcagttgttgtgatggatccgaaaagtggagcagtgctggctatggtaagtaagccggattttaatccgaacactgtttcacaggattgggattatctgaccagtgattcttcaaacagcagtttgttaaatcgtgcaacacagggagcttatccgccagggtcagtttttaaaattgtgacaacacttgcttatcttagaagtgaaaatggaaatctggataattttacttatacctgtgatggaagtattactgtagatgatcatactatcagttgctatgatggagaagaacacggaacggaagactttgaaacagcgtttgcgaagtcctgtaacagtgcatttgcaaatcttggtatggagcttggtgctaaaaaactgacgagtgcggcagaaagtctgctgtttaataaaaagcttccgatttctatcagttataacagcagtaaatttgatttaggagatcacccgggaaatccacttttaatgcagacctcaatcggtcagggaaatactctggtttctccgatgcatatggcattaattgtaagtgcaattgcaaatgatggtgtgctgatgaaaccatattatattcagcaggtacaaaatgtaaatggagacgttgtaagcaagacaaagacgtcggagtataaaacacttatgacaaaagaggaagcttccagattaaaacagttgatgcaggaagttgtaaatcgcggaacagcttcggctttaagcggagaaagttattctgcagccggaaaaacaggctctgcggaatattatggaagcgatggaagtattcatacacattcctggtttgtgggaatggcagaaaatgacgaatcacagcttgtcgttgcagtaattgcagaaggagcaggaacaggaagttctgtagcagtgccgattgcccatcagatttttaatcaatattattattaattcttaatcgtaaatccttgcacaggttctcaaaaagaggtatactaaacacaatgaaacacaacgctgaccgggaaacggtttttacaggaggacttgcaaaatggttgaagcaacgagctgtggcggggtggtaatatatcgcggaaagatactgaccttatacaaatcctacaaacataaatatgaaggatgggtattgccaaaagggactgtagaagaaggcgaagactataaggatacggcgcttagagaggtaaaagaagagtcgggagtgacagcaaatattattaaatatgtgggaaaaagtcagtatagtttttgtataccggaggatacggtagagaaagaggtacattggtatctgatgtctgcgggaagttattacagtaaacctcagagagaagaatactttgtggattccggattttataaattccatgaagcataccatctgttgcggttttcaaatgaaagacagattttggaaaaggcttataatgaatacttggatttaaaaaaagcaaatctttggggaaacagaaagtatttttaggggagaagggactggattatcagtcccttctatgctatcaggaacatactttgggaatccgagagtacataggaatagtaaggaggcaaagactatgttagaacagattgacttgacaaaaactatggaaaaagaggcttatcgtgaagaaatagcacagatggaactgactcttgcaagaatgcaaagagcatgtaaagaacagaaaatacctgttattatcatatttgaggggtttgatgcagcaggaaagggactccagattaacaaattgattcatccgttagacccaagaggattccacgtatatgcaatgaaaaaagagacaaagacggagcagatgtacccgtttttgtggcgcttttggacgaaaaccccagaaaaaggaagaattgcaatttttgatacaagctggtatcgtcatgtatccgttgatttttttgaaaagaaactgtcaaaagaagaacgaaatctggcatatcaggaaatcaatacatttgagcggactttaacagatgatggtgcggttttgataaaattatttcttcatatcagcaaaaaagatcagaaaaaacgttttgaaaagctgcttgagtcgaaagagactgcgtggcgtgtcagcagggaggatttagaacgaaataaaaattatgatggatataaatcaattttagaaaatatgctggaacagacagagacggaatatgcaccatggacgattgtggaagcaacggataaaaaatatgcaactgctaaaatttatgcaactgtaattcaccagttagaagaagcactgaagaagagaacagtgcaaaaagaggaaaaacagacagaaaagcaggagaagaagcaaaagctgtttgaggcttctgttttaagcaatgcagatttaagttgttcttacacaaaagaagaatataaagaaagactacaaaaactacagaagaaaattgcggttttgcacagtgaactgtacagaaggagaattcccgtggtcttaggatttgaaggctgggatgctggtggaaaaggaggagcaatcaaacgtctgaccgagtttatggatccaagaggctatgtcgtaaatccaacagctgcaccaactgaagttgaaaaaaaccatcattatttatggagattctggcagaacatgccaaaagcaggacatattgcgatttttgaccgtacctggtatggcagagtaatggtagaacggattgaaggcttctgtacaaaagaagaatggcagagagcttatcgggaaatcaatgatatggaagcacatcttgcgaattccggagcaattgtaatgaagttctggatgcagattgataaagatgagcaggaaagacgttttaaagagcgtatggaaaatccggaaaaacagtggaagataacagacgaagactggagaaaccgggaaaaatgggaacagtatgaagaagcggttaatgaaatgattattaaaacatcgacctcttatgctccgtggacaattgtagagggaaactgcaagtattatgcaagaattaaagtattggagactgtagtaaatgaaattgaaaagagattaaaaaagacagattaggaaaagtatatgttaaactggtataaaaatctgtatattggcgataatgcaaaaaagaaatcaaagaaactaatacacaaaattaatcagggagcaggtgtaattgacgtgtatgtcattgcacttgcggttaatcctgaaaattcattggaaatcttttcagcaaatttattgatgcagagtgcgcttagacgaaattgcccgacgattatcgggcttgcaaaagggtatgaagaggcacttgagattatagagcagattgtaaatgaagtttatcaggagactgggacagcggaaattcggacatggcttgaggcacgaatagaaaaaaatggaaggaagaagaaaaggagtaggacatgatgtggatacatattattttggtacttcttaagataatcggaatcttgcttctggttgttgtatctttacttcttttagcaattttttcaattttgtttgtgccggttcggtatcaggcttatgggtatcgtgataatcaaattagtaaaggaataataagagtcttctggctggcgcgtttgatttcttgtaaagtcagttatgacagttatggaaagaaaataaagtggtctgtaagaatttttgggatttccatacagaaagtaacggcttggaaaaagaagagaaaaagcagaagacaaaatacgaagagaaagaaaacgcagacaaaaaagacggaaagaaaagaaacagaaaccgtattaaaagcaaaagaactacaagagaacatagagcaggaacagaatcagaatgcaacagaggcagaacaaaaaagaaaaaaagttaaagatattgaacagaaaccagagaaagtggagagaatagaatcagaggaaaatcagaaaagaaaagagggcaaacactcgccgatatcaatatttttcaaaaaattaaaaaaaatattagaaattccccgaataactcttcgaaaagttaaaaaaacttggttaacagttcatgggatttgtgataaaataagcgaaatccgaacatttttagagtccgaggtatttttaaatgcaaaaacattattacttggagaggtaaaaaaacttgggcttcatattcttccaagaaaagtacaaggagagattgagtttggatttgatgacccttctttaacggggcgtgtactggcagttgctggtatctgttatccgctttatggaaataatattaaagtcaccccttattttgataggaaaattttggagggtgaactcaaagtgaaaggaagaatccgtggaattgtacttttaaagagtgcgttaaaagttagctttaatcaagaagtacgagaaatctggaaaaattttaaaggataaaaacagtgaaggaggaagcaggatggcttcagaaaataactttaaggcaaccgtagattctttgtttaaaggaatggatagctttattacagctaaaacagtggtaggagaggcaatcacggtgggcgataccattattctgccactgattgatgttacttttggagtgggagcaggagcgttttcacaggataaaaaaaataatggcggtggcggaatgggaggaaaaatttctccaagtgcagtgctggttatctcaaatgggacaacgaaattagtgaatattaaaaatcaggataccgttacaaaactgcttgatatggttccggatctaattgaacgttttacaggagagaaaaaagaatcaaaggaaaatgaaaaagaagattccgtagaaagtttggtaaaagatattgtttcttcagcagataaaaaagaagaaaacgagagtacaaaggaagagtagaatagataaaaaactgttgtgaagtacattcatgacggttttttgcatatagtaaagtaaaccataaaggagcggagagttgtgtgctgcttacttggatttttgctattttggctgggagcggggatgtttctggctctggtttttccgaaatgtttttttatggtgctggcagcagggctgtgtatgctgataggatataatcttttttgtggaaaaaaatagagaagatttaatgagagaaagagtaataatagatataaaatggaacatgaaaaatgtcggaaagaaaaagagtccggaaatcaattccggactcgatgatgcgaaattacgctctttctactttgttgcttcttaagcaagaagtacaaacgtacatcttcttagcagctccgttttctgttttaactttaacagatttaatgttggatttccacattttgtttgatcttctatgagaatggctcacattatttccaaaatgagcagctttttcacaaattgcacacttagccatgatagcacctccttaaactaaaataagtccgtgtatacaaactcacaacactagttattttaacagatgatttgattttttgcaagtaaaaatataaattttttaaattattatttcgtttttgggaaagatatgttagaatagttctatcaaaaaggtatggaggtgtccgtgcatggaaggacttgtagatacaggattaggaaaaatagcaattgatacagatgtaattgccacttatgcaggaagcgtagcagtggaatgttttggaattgtaggcatggcagcggtaagtatgaaggacgggcttgtaaagcttcttaaaagagacagcctgaaacatggaattaatgttggaattactgataataaaatcactcttgaatttcacgtgattgtggcatatggtgtaagcatctccgctgtatcagacaatctgattagtaatgtgaaatacaaggtagaggaatttaccggtctgacaatagaaaaaattaatatccttgtagagggtgttagagtaattgattaattaaggaggaaacttgttttgaataccaataccgttgatgcaaagatgcttggcagaatgtttttagccggcgctaagaatctggaggccaaaaaagaatggattaatgaactgaatgtatttccagtaccggatggagataccggaacgaatatgacacttacaattttgtcagctgcttcagaggtcaatgcactttctgaaccatctatgaaaacactggcaaaagcgattgcgtcagggtctcttcgtggggcaagaggaaattcaggtgttattctttctcagcttcttagaggatttgcgaaggtaattgagcagtatgaagaggtggatgcaccaatttttgcaaaagcgtttgaaaaaggtgtcgaaactgcatataaagcagttatgaaaccaaaggaaggtacaattcttaccgtggcaaaaggagcagcagcaaaggcagatgaacttgcagaagaagcagaaaatttgaacacgttctttgaaggagtaattgcttatgcacaggaagtgctttctcagactccggagatgcttcctgttttaaaagaagctggtgtagtagactctggcggacagggtctgcttgaagtattgaagggtgcttatgatggatatcttggaaaagaaatcaatatggattttgaagcaccaaaaggaacggcagctgtttctaaacaggctccggcagaagaaagtaatattaaatttggttattgtacagaatttattattatgctggaaaaaccgttcccgattgaagaggagcatgcatttaaagaatatttgatgtcaattggagattcactggtagttgtagcagatgacgagattgtcaaggtacatgtacataccaatgaacctggaaatgccattcagaaagcgctgacttatggacaactctccaatatgaaaattgataacatgcgcctggaacatcatgaaaaagtaataaaagaagcagaaaaaatggctgcaatgcaaaaagaacaaatgccggaaaaagaagttggatttatttctgtatctgtaggagatggaatgagcgccatctttaaagatttaggagcagattatctgattgaaggtggacagacaatgaatccgagtacagaagatgtactggaagcgattgcaaaagtcaatgcgaaaaatatttttgtatttccaaataataaaaatattattctggccgcaaatcaggcaagagatttgacagaagataaaaatattattgtcattccgactaagacaattcctcagggaattaccgcattaattaattatgtgccggaaaaaacaattgaagagaacacagaagaaatgctggaaagcatcacaactgttaaaacaggacagattacctatgcagtgcgtaatacaaagattgatgaaaaagaaatccatgagggagatatcatgggaatcggagaccatgggattttggcagtgggacaggacgtagaaaaaacaaccttggaaacagtagaagcaatggtggacgaagactcagaaatcatcagtatttattttggtgcagaagtaagtgaagaagaagctgaagtactcaaagaagcattggaagaaaaatatccggactttgatattgatgtaaatcagggtggacagccgatttattattatgtaatctctgttgaataaagaatgattaagaaagaaaaggaaaaaagatgtttgtacaaaaattgtgcggacatcttttttgtacgggtgaaaaatggaaaaacaggaatccattcgtaatttaaaaggaattggcgagaaaacagaaaagctgtttcatatacttggaattgatacaatacaggatttattggattattatccgagggaatatgaacaataccggattccggtatctgtttctatggtgcgggcaggagaaaagattgcagttttgggaaaaatcacgcaaagtatcagcttaagaaataccggaaggctgacacttgtgacggcaacgctaaaagaagcaggacgggaattacagcttacatggtataatatggcatttttaaaaaagacgttagtttttgggggtacttatatttttcgaggtgtggtatctgaaaagaaaaacagactggtaatggaacagcccgagattttcaccaaagagcaatatcagacaatgcagaaccgtttactgccaatttatagcctgacaaaaggaatgacgaacaaaatgatagcaaaaatggtacgtcaggttttagaagaaaaagaaatcgaacaggagtatttgtcagagaagataagaacttcctgtcagttagcagagtataattacgcagtgcaagagattcattttccaaaaaacagggaaaatatgattctggcaagaaaacgactggtattcgatgagtttttaatttttctcttatcagtccggcaaatgaaagaaacggttaaaaatgagaaaaatttatttgggataaaaccggtgtcagaaacggaggctttgattcagagtcttccgtattcgcttacgaatgcgcagaagaaagtatggcaggaaattcagaaagatatgacaggagaaaaactgatggcaaggttggtgcagggagatgtgggaagtggaaagacaattcttgcgtttctggcaatgctattgtccgcacaaaatggatatcaggcagcacttatggttccaacggaagtattggcagtccagcattttgaaggtttaaaacagcttttagaggaacatcagcttgattttgaagcggtattgcttaccggttcaataaaggcaaaagaacggcgggaaatttatcagaaaattgaaaatgggaaagcaaagctgattatcggaacacatgcactgattcaggagaatgtaacttataagaatctggcacttgtcattacagatgaacagcatcggtttggggtgcatcaaagagaggatttatcgaaaaaaggcaaacgtccgcatgttttagtcatgagtgcaacaccgattccgagaacgcttgccattatgctgtatggagatttagacttatctgttattgatgaactgcctgcaaatcgtctcccaatcaaaaactgtgtggtggataccagctatcgaaaaagtgcgtatcgttttatgcaaaaagaaattgcagagggacgtcaggtttatgtgatttgtccgatggtagaagaaagcgaagggctagaatcagaaaacgtactggattacacaaaaaagttaagacaggaaatgccgccagagatttccgttggatttttgcatgggagaatgaagccggcggaaaaaaataaaattatggaagaattttccgaaaataaaattcagatactagtctccactaccgtaattgaagtgggagtgaatgtgccaaatgcaacggttatgatggtagaaaatgcagaacggtttggacttgcgcagttacatcagttaaggggaagagtcggaagaggtgaacatcagtcttactgtattttcatgcagggaggaacaaaaaaagaaatcaaagaacgacttcagattttagtagaatctaacgatggattttttattgcgggagaagatttacgcttaagaggtccgggggatttatttggaatcagacagagtgggattcttgaatttaaactggcagatatttatcaggatgcagctattttaaaggaagcttctattgttgcagatgaaattttagaaaaagacccgcatctggaatcggaagaatataaagggttaaaaaacagactggaattttatgcaaaagagcagatgaaacgacctggaatctgatgggaatcagaaaaaacttgaaaaaaaaggtaaaatggtttatgataaacgagaatcatgtaagggctacataaaggaggagattagtatgcctagaacaaaaacaacaaaggctgcagttacaaaaacaacaaaagcagctgtaacagaaaagactactccagttaagacagaagaaacagtaaaaacagaagaagtaaaagatgtagaaacaaagtcagaagaaactaaagcagaagaaacaaaaaaagctgcatcatctaaaaaagagccggtaaaaagagcaaccagaaaaagaacagcaacaacgaagaaaacagctgtaaaaaccgttacaaagagagtgaatattcagtttggcggaaaagaccttaaaatcgaagagattgaagcagctgtaaagaaagcctggatggatgaaaccggtaaaaaagagacagaaatcgaaaaacttgaaatttatattaaaccagaagaatctgctgcttattatgttgtaaacggcgaatatgtagaagaaggaaagaaaatcgatttataagactataaaacgcaaagtaagagggaagcttcttaagtaaagaagcatccccctttttgattttctttctttttagagattagaagaaccgctggacatctgacgttcctggttttcaatcatttttttcaccatatagcctccgacagaaccgttctgttttgaggtaaggtttccgttgtatccatctgtcagagggacacctaattcgcttgcaacctcatacttgaatcggtttaatgcacttttggcttctggtacggctgtactgttagaagaattactgttagacatggttttcttcctccttttgtcgtctgtttttttgttacaatggtagtatgtgaaattctattttttttattctggaaatgtttacaggttttgacaaattatgagaattgtattaaaatatctattcagcaaaagaaacgctaagaaaattatgtattttcaatctgatattgtaaaaaatgcataaaatgcaaaaaaataattgcggatagttgttgtatttgctataataaatctgataaaaaaaagaagaggatggttgaatatgaacgttggtataattgcacacaacagtaagaagcctcttattgaagatttctgtattgcatataagaatattttggcaaagcatgaagtttatgcaactggtacaacaggaagaagaattgaagaggtaacaaatcttcgcgtgcataagtttttgccaggaagtatgggcggtgataaacagattacggagatgatagaacgtggagatatagatatggtaatctttttttacaatccttctatgattaatccaaaagaaccggatgtctatcagatttcccgttgctgtgaccagtataatgttccgattgcaaccaatattgcaacagcggaatctttaattctcgggttagaccatggggatttagactggcgcctgaacaagtagagaagaggatttaagctgaatatgagagtaattgcaggaagtgcaaagggaatgcccctcaagacagtttcaggaatggagacaagaccgaccacagacaggattaaagaaacattatttaatatgcttcagtcctatatctgtgactgtcggtttctcgatttattttcgggaagtggagccattggaattgaagctttaagcagaggggcagtttcttgtgtcttaatagaaaaaaataagaaagcagcaaactgtattctggaaaatctgaaatttacccgtctaaaagataaggcggaagttatgaaccaggatgtgtttactgctctttccatgttagaaggaacagaaccgtttgactgtatttttatggacccgccatacaataaagaactggaaaaagaggtgcttgcagtgctaagaaatgcttcttatgtaacaaaagatacgttaattgtagtggaagcatcgttagagacaacatttgattatgtggaagaatacgggtttgaaattgtaaaaaataaaaaatataaaacaaacaggcatgtattcttaaggaaggaataaaaataaaaaatggtaagagcaatttatccgggcagttttgacccggtaacttttggacatttagatgtcattcgacgtgcatcggaactttttgacgaagttatcgtcggagttttacataattctcaaaaaagtccgttgttttctgtggaagaacgtgttaatatattaaaagaagtgacggcagatatcccgaatgtaaaaattgagacctttagtggtctttcggtgaattttgcccgaaactgtgatgcaaaagtaattatccgtggactgcgggcaattacagattttgaatatgagcttcagatggcacagacaaaccgtgtgttggcgaaagatgtggataccatgtttttgacaacaagtctggagtatgcgtatttaagttctactacggtaaaagaagcagcatattttggtgctgatatatcaaaatttgctccggaatatgtagtagaaaaagtgagagaaaaatttgcacaaaagggtaataaaatacaataaggagtgtaattatgagtagcagaattgagcagattattgaagaaatcgaagaatacgtagaaagttgtaaataccagccgctttcaacaacaaaaattgttgtaaataaagaagaattagaagaactgcttcgtgaacttcgtatgaagacaccagatgaaatcaagagatatcagaaaatcatcagcaataaagatgcgattttagcagatgcacaggcaaaagcagatgcagttattgcagaaacaaaaacacaagttcaggatatggtaaaagagtctgaagtaatgcagcaggcttatgcacaggcaaatgaaattgtaaacagtgcaaatcagcaggcacaggcaattattgactctgcaacagcagatgcaaataatttacgtttaagtgcaatttcttataccgatgagatgatggcaaacttagaacagctgattcatggaacgatggaaaatgcaaatgcaagatataatgagcttgcacagacttataatgcatttgcacagtctcttcagagtgcggcagatgtggtgagcgaaaacagaagtgaacttgcacctcagttaaataatccgattccgaaacagacagaagaagagccggaagaaaatctcgatatggatgatttagacgacgagttagaagaggatgacgaataaaaaagtaagtcctgaggcaatgagggtacaaacgattcttccgattagataaggaaagagagggaggtctgtgcctgaaagtacgcaggaagtctgagcaagtacgcaaagacctccaaagctggaaaagcccattgtcaaaggaaactttaaagaaaatggcagagcagtgtcttttaaagcattaagtccggtggaaaattctgttagaccacaaagcatgactgaaaagaaagacgaagaagacagcaggaattgaaggattccttgaaaaacagaaaacagaataatatatccaccaagcttggtaatagaaaaaaggctattcataatagagatatccagaagttccgcaaaaggagaagaggatgtctctttttgcgttcgggtaaatacagattgctgagaaacagagtaaatccggcgaaaaaaaagactggtaagaaacgcagacagaaaaaagatgaaaaaaagcagatgattgggaacctgattttctaaaatagaaaatgataaatatccggtcagaaaagaagggcttggaaaagcagaaaatgtcaaaagatagcaggcttcctgtttggaaattttattagattggtataaatctgctgtagtttttgcacccattggaaaaccgcataaaattccaaataaaaatgcagaagcaccaaagggggtaagagaaaaaacagaatgccagaactttttgaaagatacgagaagcggttcaagcagacccgaagaaattaaaatggcggataataccattgcaggaaataaagagggcaaaagtgtagaaaaccaaagccggatgcccaaaagagccgaagaaatacaaatctgtggaaataacaaagaaaaaagaaaacaaaaaagacaaaaaaaagaaaaaaacagacgtttcataaatagattctccgatctctgattcaaattcacatcataatatatggaacgggtgaaaagaatatgtccttgccatttggaaaaagatgtgacacaataagaaagaataaaaagtgtgtctgcactgcagattaccttggatatggaggcagaaaatggcagtattagaaaatttaaaaccagaaagagtgttttactattttgaagaaatctgtaatattccgcatggttcaggaaatacaaaacaaatcagtgattatcttgttgagtttgcaaagaaaaaagaacttcgttttattcaggatgaaatgggaaatgttgtaatttttaaagaggcatccaaaggatatgaagagtcaccaacggtaattttacagggacatgtagacatggtgtgtgaaaaaacagccacgagtcagcatgattttgaaaaagacggtttaaagctgtgcgttgagggtgatgaaatctatgcaaaagatacaacgcttggcggagatgatggaattgcagttgcttatgaactggcggttttagaagatgagacacttgcacatcctgcgattgaggcagtgtttacggtagatgaagagattggtctgttaggtgcagaaggatttgatacctctgtgttaaagggaaaatatctaatcaatctggattctgaggcagaaggatatttatggagtggatgcgctggaggacttaggagttacagtgagcttccggtaaaacgtgtggaaggtacagggctttcttgtaaaattacagtggatggactgcttggcggtcattccggctcagagattaataaaaaccgctccaatgcgatacttcttctggcaagatttttgcatgagtgtggaagtgaattagacttgtttttatatgatatgaaaggcgggcagaaaaataatgcaattccacgacaggcagatgcagaagtattagtttcagcagaagatgccggtcgattagaacagatggcaaaagtatttacttctacccttcaaaaagaatacacaggcagtgatgaaaatatccaagttcatgttgaagtacaggaggagagtacaaaacaggtacttcatccggcgagtcaggagaaagtattatttttcctgattcattatccaaatggaatccgcaagatgtgtggatttatagaaggactggtagagacctcctgtaatgtaggaattgtgcgcttgatgccatcaacctttatctgtgagacaagtgtgagaagttctgttggttcagaaaagagagcacttgcagaccagattcgttatctgacagaatttctcggtggagaatatgatgaagacggaaactatccggcatgggagtataaaaaagattctgtacttcgtcctctgatgaccaaagtttataaagaaatgtatcaaaaagaaccagtggttgaggtgattcatgcaggattggaatgtggtctgttttatgaaaaaataaagggactggactgtgtttctatcggaccggatatgaaagatattcatacttcggaagaacgcctttctatttcatccactaaaagagtatatgaatatttagtagaagtattaaagagaattaaaaagtaactggaataaaatcccttttccgttcatagaatgataagtgtgaacaatacgaagtcaacttgaatggataagggattttatgatttctttctggtatggatgtaagaaatatgatatacttaaaacacgtatgcgtaaaaaacagattagaaaaaaagcgcagaaagtctgttgatgattccaaggcgcaatgacaaggagtaatgatttatggaaatacgtttatggcatgagcttttgcttccttatgagcttgccgtgaaagaaatggtaatcaagttcaaacatcttaaaaaggaacacagggaaaaggaactttattcaccgattgaacaggtcagcggacgagtaaaatcaatcaatagtattcttgagaaaatgcagagaaaaaatatttcatgggaagaacttgaagaaaaagtagaagatatcgctggaatccgcattatctgccagttttctgaagatattgaaaaagtggcggatattattcggaaacgtcaggatatgagggtactggagataaaagactatattacgcatatgaaagaaagcggttatcgaagttatcacatgattattgcttatcatgtagagactttagaaggaccaagagaaataaaagcggaaattcaaattcgtacgcttgcaatgaatttttgggcaacgattgaacattcgctgcagtataaatataaaggaaatatgccgcctcatgtaagaacacggttaaataatgcggcacagtcagttttaactcttgacgaggagatgtcatccgttcgtaatgaagtgatggatgcacagaactctatggttcaccagtccaatattgtaaaagaaattttaaataatattgagaatctgtatcattattcaaataacagagaagtggcaaaaattcaggatgaattttaccgcatttatgaatcaaaagatttagcacgcttagagcgttttcatcaagagttagatgtaattgcagagggataccgtgcgcaggcggttgcgacagaggaaatcttgtaacagcaaaggaaaacttatgagactaccagagaaatatgaaaatgaaatgaaagacctgttgcaggaagaatatgaggcttataaagaaagcctcggtcttccgatacagcagggatatcgaattaatacaggaaaaatcagcaaggaggagtgggaaaaaatcgctcctttttctgcgaaagaggttccatggatagaaaatggatactttcttttagatgacttcagagcttccagacatccttattattttgcaggtctttattatttacaagagccgagtgcgatgacaccggcaaacaggctaaatgtagaaccgggagattttgtactggatttgtgcgctgcacctggaggaaaagcaacagagcttggaagccgtttaaaaggaaaaggcatgttagttgcaaatgatatcagcaacagcagagcgaaagcacttttaaaaaatctggaactggcaggaatagccaatctttatgtaacaagtgaagaaccggcaaaactttgtcaaaatttcccggaattttttgataaagttttaattgatgttccttgttccggagagggaatgttccatagagaacccaaaatgatagaatactgggaaaaacgaggtccggaagaatacgttccaattcagaaacagcttattctgtatggaagccgtatgttaaagccgggagggaaactcctttattcgacctgtacgttttctaaaaaagaagatgaagaggtgatacaatggctgttggaacaaaatacagacatgcatctgatttctattgctccttatgagggattttcaaaaggatttggattatcagaatgtgtgcgtatttttccgcataaaatgtctggagaagggcattttttggcattgcttgaaaaaaaatctacagaacaagacaacacacagaaacaaaaactgcaaatgggaaaagaattgaaactcccaaattgcgtagaagaatttttttcattattaaagtttccgattgacagaagttgtctgaagttggaaaaagaacgattgtatctgctgccaaatgcagtgaagatgccaaaattgcgttacctgcggaccggattgttgttaggagaagtaaaaaagaaccgctttgagccttcgcaggcattggcaatggctttaaaaccggaacattttgcatcttgtatttcaattgacagtacagatgtgcgctgtgtgaaatacttaaaaggagagactttagacgtctcagaccttccctgcaacaataaaaaaggctggcagttagtctgcgtggaacggtatccactcggatttggaaagttaagcaatggcattttaaaaaataaatactatgccggatggagatggcagtagatggcacaaataagaattgataaatatctggcggatatgggaattggaactcgaagtgaggtaaaaaaaatcttaaagtccggtcaggtaactttaaatggagaaaaaatcaaaaaaccagaacaaaaaattaacagtgaaacagacgaagttttagtaaatcagaaaccggtggtctatcaggaatttgagtattatatgcttaataaagctggaggagtggtttctgcgacaaaagataagaaggaaaaaacggttttggattgtatcgattccaaaaaacgaaaggatttatttccggtaggtcgtctggacaaagacacagaaggattactgctgattacaaatgatggagaactggctcatcgtttgctctctccaaagaaacatgtggataagacttattttgtgaagttaagagaaccgttaaagcaggagtatgaagcggcgcttgaaaacggaattgatattggagaggaagcattgactttgccggcaaaacttgaaatttgttccgaagatagaaaaaactgtctgcttacaattcatgaaggaaagtttcatcaggtaaaacggatgtttcagtcagcagaaaatgaagtggtatttttaaaacgaatgtcgatgggaagtttaacattagataaagcattagaaacaggacagtatcgtccgcttacacaagaagaaatagagaggttgaaaacgaatgcttaaaaacataaaagcagtattgtttgatttagatggaacgttggttgactccatgtggatttggaaatccgtagatgaagagtattttgagaaaaaaggacttgttctttcctcagatgagattgattcattccagcaggaattagagggaatgggatttacagaaaccgcagtgttttttaaaaagcgatttggaattgaagattccctggaagaaataaaggcagcctggatttccatggcaactgaaaagtactgtaatgaagttccgttaaaggatggagtaaaagaatttttagaatatttaaaagaacagcagatcccgtctgcgatttgttcaagcaacagtattgaattgattaaaatggtgttaaaggcacatgaaattgataattattttaccaaaatgataacctgctgtgatgtatcagcgagtaaaccggcaccggatgtttatcttgcagcagcaaaagccttaaatgtaagtcctgaaaactgtctggtatttgaagatgttccaatgggaatcttagctggaaagaatgcaggtatgaaggtatgtgccgttgaggacagttacagtaaagaacaaatggaacaaaagaaaaagcttgcggactattacataaaagattacgatgaggttttaaatcagacatttgaggtgttaaaatgatgcagtttttaccggttacgatgaaagaaatgcaaaatcgtggaattagtcagccagatttcgtatatgtctgtggagatgcctatgtggatcatccgtcttttgggatggcaattattacaagacttttagaacattatggatacagcgtgggaattattgcacagccggactggaagaaaaaagaaagtgtctgcgtatttggagaaccaaggctaggatttttagtctctgccggaaatatggattcgatggtaaatcattataccgtttccaaaaagcacagaagggaagactcgtattctccaggagggaaaatgggtcttcgaccggaccgtgcagtaattgtgtatgggaatttaatccgtcagacttataagcataccccgattattatcggtggaatcgaggcttctcttagaagactggcacattatgattactggtcagattctttaaaacgttctgtattattagattcaggagcagatttgatttcttatggaatgggagaacgcagtatcttagaaattgcagaggcactcaatcgtggagaagatatttccactctgcatcatattgcaggaacggtgtatcatacaaaagaagcacctgcgggtggaatcatccttccttcttatgaagaaatgtgtgcagataagagaaaatatgcagagagttttcaggttcagtatgaaaatatggaagcgttttcaggaaaagtattggcagagtcctacggaaatcgtgggtatgtggtacagaatcctccctcaaagccgttatcccaaaaagaaatggatgaggtttacgatttaccgtatatgaggacctatcatccgatgtatgaaaaactcgggaagattccggcgattgaagagattaaattcagtattacaagtaacagaggctgttttgggggctgtaatttctgcgcacttgcatttcatcagggaagaattgttcagacaagaagtcatgaatctattttaaaagaagcagtggaatatacaaaggaatctgattttaagggatatattcatgatgtaggaggtccaaccgcagatttcagacaaccagcctgtgaaaagcagctgaaaaaaggagtctgcacgaaccgtcagtgcctgtttccaaaaccttgtaaaaatttaaatgcagaccatgaagattatctggaattattggaaaaactcagaaagattccaaatgtaaaaaaagtattcatccgttccggaattcggtttgattatgtggaagcagacaaagacagtcgctttttagaagaactggcaaagtatcatgtaagtggacaacttcgtgttgctccggagcatgtttcagaccgagtgctgtcttatatgggaaaaccggaacatcaggtttatcagaaatttttagcagactttgaaaaggcaaataaaaaaaccggaaagaaacaatatgtggttccatattttatgtcctctcatccgggctgcaccttaaaggatgcggtaaagctggcagagtatgtgcgtgatatgggatttatgccggaacaggtgcaggatttttatccaacaccatctacgatgtctacctgcatgtattatacagggattgacccaagaacgaaaaaagaagtttatattccgacaaatccacatgagaaagcaatgcagagagctttgattcaatataaaaacccacagaatcgtgaactggtaaaagaagctctgataaaagcaggaagaacggatttgattggatgggagcataaatgtctgataaaagaaggaaaaaaaacggtacaggcagaaaaagatttcaagaaatcaaccgtacagcgaaaaaagaaaacgattcgaaatgtgcataaaaggaaaggaaaataagatgaaaatagcaattgtaacaggagcgtcttctggaattggtgcaagttatgtctgtcagcttgcagaaaagtattcatggctggatgaaatctgggtcattgccagaaatgaaacggcactctggacactgaagcgacagtgtatagtgccgctccgtgtttttgctatggatattactcagacagaaaatttgctgagactggaagaagaattagaaaaagtaaaaccgtatgtgaaatactttgtaaatgtagccggatgtgggattaataaaaagataaaagagacagatttgatggattgtaaccgtatgcttgaagtaaactgcaatgcattgaccctgcttacgaaaattgtacttccgtactgtggaaaacgaagcagaatcgttatgttagcttctgcttctgcttttttgccacagccgggatttgctgtttatgcggcgtcgaagtcttatgtgcttagtttttcaagagcactgcgcagagaattaaaaaagacaggaacgaccgttacaattgtatgcccaggtccggtagatactccgtttttagatacaatcggcgggaaagatagcattccggttatcaaacgaccatttattatgaaaacggacaaggtagtttcagtcgcaatcaaagatgcggcaaaaggaaaggaactgtcgattccgggaatttcaatgaagtgtttttttcggatttgtaaaattgttccgcataaagtattgttaaaatttacataaaacaagacaagaacaagatacataaaaatgaggaattacatgaataaaaaacaaaaaataaaaaaaggtgatttcggatatattcagtcacagaaaaagaagcgtacgatttatacgattttagctttgattccaccactgacagttttctttgttggctggattatcaataaagacaggaatacagtatttactgtttttgcagcggtggggtgtctgccggcatgtaaatttgcagtcagcgcaattatgatgtatctgcaaaagccaatgtcagaggacgattataagcagattgagcagcataaagaaggtttggtgtgtgcgtatgaactgccggtttctgcttatgaaaaacagacctttttagattccgttgcagtctgcggaaataatgtggttgcatataccagccgtgagaaatccgatattccgtttgtggaaaagcatattcagaccattttaagacaaaatggatattatgtaacgataaaggtattcagacgtcttccggaatatttaaatcgtttggattctatgtgggagcatcatgagtcactggaagaaggcattcgatttgtgccggatgaaaataatccggatttaagcagaaatgagctgattatgcatactatttttgcaattacgctttaggagaaataaatgaaagaattagaagtaaaagcgcaggaaagcggacagcggtttgataaatatctttccagatatttaaaagaagcaccgaaaagctttctctataagatgcttcgtaagaagaatattacgttaaatggaaaaaaggcaagcggaaatgagaaactcgaagtgaatgataaagttcagttgtttttttcagatgaaacattagaaaaatttatgggagaagaaaaagaagtgaaaaaaggttctctcgaaattctttatgaagatgaaaacgtgatttttatcaataaaccggcagggatgctttcacagaaagcaaaaaaagaagatgtttctttaaatgaatatctggcgggttatctgcttgattccggagcgatgacaaaagaagatttcagaacctttcatccggcggtgtgcaatcgtttggatcgtaatacgagcggaattgtagcagcaggaaaaacaatggcaggacttcagacaatgacgcagttgtttcgggacagaaatcttcataaatattatctggcactggtaaaaggaatcgtaaaagaagaagctcatattaaagggtacttaaaaaaagatgaaacttcgaataaagtaacgattaccagacagccacagaaagatacagttttgattgaaacgaaatacactccgattggatgttcaaaagaaaaccggctgactcttttaaaggtggaactgcttaccggacgttctcatcagattcgtgcgcatctggcaagtatcgggcatccgattgtaggtgatgcaaagtatggagatatgcaggtgaataaaaagtatcatacacagtataaagtaaaaagccagcttcttcattcctggaaattagtactgccacagttagagggtgagctggcaaatctttctgatatggaaattacagcgccggttccaaaggtattaaaacagattattacaaaagaagtgaaaacagcagaaggagagattggatgagcaaaaaatatgaaggtccttctatgatggaagaactgtgggaatatgtaaaaatgattgtgttcgtagtggtaattgtttttattatcaataatgttttgttaattaacgcaagaattccgtcagaatctatggaaaaaacgattatgaccggagacagggtttttggaaatcgtctggcttatatgacaaaagacccggaacgttttgatattgtgatctttaaatttccggatgatgaaagtcagctttttatcaaacgagttattggacttccgggagaaacagtaacgattaaggatggtaaagtttacattaatgattcagaagaaccattagacgacagttttgttgcggagacaccggtaggtgattttggaccgtataaggtgccggaaggaagctattttatgcttggagataatcgaaatcattcccgagattccagatactggattaactcctttgtagaaaaagataaaatccttggaaaagcagttttgcgttattttccgtctccaaagctgataaaataaatgtgttcttataattttttgtgttgagtttgtgagaagattttgagagtacaaaaaatgtacggtcggaaacaaaaaactttgaggggatataagataagagtggaggcaggaaattggcaacttggaactcaaggggactgcgaggttctgcattagaagaatttattaatcaaacctgtgaacagtatcgtgaaagaaatctggctttaattcaaaaagtgccgactccgattactccggttcggattgaaaaagaaagccgtcatattacacttgcttattttgacaagaaaagtacagtcgattatattggtgtagtgcagggaattccggtctgctttgatgcaaaagaatgtcataccgataattttcccttacagaatattcacgaacatcaggtgcgatttatgggagattttgaaaaacaggatggaattgcatttttgattctgtatttcagtcatagagacgaaatttattatatgagatatgaggaaatgctaaaattttggaatcgtggacaaaatggaggacgaaaacactttaagtatgaagaattgaatccgaaatggtttttaaccagaaacggaaattacctggttccgtttctggagggaattgccttggatttaaaagagagagaagagaattaatttttctctgtggtttctcttggaattaagacaggagaaataattttatggactggctcgcaaaaagccggtctttctttttgcgcttgaatttgtgagattaataactcaacggcttcaaatgcaatcttgtcaatctgctgactgacgctgctgattggaataatagcttctcgtgaaatcggagaatcgtcaaatgcaattaaaaaatagtcgtttggcagatagccatactttcggattaacagatttaaaaatacatttgcataagtatcaccggagataaaaattccctttcggataccggaataattcagttcaatttgttctaaaatatgagttaggtggctttttacttcttcgtgggaagctcccatctcttccataaaagtatgatgtagtaattggtgtttttcacaataatcatcaaatgcttccactcgtttataagcaggagttgttcgggttgttggagcactgatatgcaaaaatacttcacagtcatgggaagagagattttcacaggcgagaatcgttccttgatagttatcggaattgacacttgagatataaacatcttcccgctctacagcaactaatggaagatgaagatttgccagttcaatcgagggaagtgtgtgacttaagataattaatccttcaatcttataagctaaaagttcctgtaagtaagttctttcatcttcttttgagccattgctgataaaaaccagaaatttatagccaaaagcttcataggttgataaaatctgatttaaaatctcagaataataacgaacatataagtttgggatgatgatgccgataaattcggtacatccgttcgccagaatttttgcaactttattttctttataatttaatttttcaagtgcctctgcaataatgttccgattttgttccgttaaggtctccggatgattaaaataacgggagattgtagtttttgaaaagtttgtatattttgcaatgtcactgaatgtgatgttgttttttttatttgccatagtaaaataccgcctttctaaaaatcagtatatcaaaaaaaagaaaaagagacaatggaattttataaagtaaccggttttacaaaaatgacaaaaatccgaataaaaattgataaaaatgctgaaaaatacttttattattgagatatagataggtttgtgatagaatacagtatagaaaaaccggttactttacaaaacgaaattaaaaaatcagattctgggaggaaaaaatgaataaaaaagatatgatttttcaggaacgattaaaccgtcatcacgacgaacttcgctggctgtatatggaactttatggaaatgacgcaatgtttgcagaattatgtgaccagatgtatgagtattacaaagcaagaaagcaaaaactgcataatcgtgatgcaaaacgaataaaagaagcagagtggtttaagaaaaaagacatgcttggaatgatgctttatattgataattttgctggaaatttacagggtgtacagacaaaactggattatttaaaagaatgtaacgtaaattgtattcatctgatgccgtttttagattcaccggaaggacgttctgatggcggttatgcagttgcagattttcggaaagtaaaaccagagcttggaacaatggaagatttagcaaaattaacggatgcctgtcatgcaaaagacatgaatgtgtgtatggattttgttatgaatcatacatcagaagaccatgaatgggcgaaaagagccagaaatggagaaggcgagtacatgagccgttacttcttctatgataatgatgaaattccaaaacaatatgaaaaaaccgtaccacaggtctttccgacaacagcaccgggaaacttcacgtatcttccagatttgaatcattatgtattgactaccttttatccatatcagtgggatttaaattataaaaatccaagagtatttaatgagatgatgtataattttctgtttcttgcgaatcagggaattgatgtaatccgaattgacgctgttccgtatatctggaaagaattaggaacaccgtctcgtaatcttccacaggtacatacgattgtacgaatgatgcgtatgattggtgaaattgtatgcccaagtgttatcttacttggagaagttgtcatggaaccggaaaaagtagtaccatattttggaacagtggaaaaaccggaatgtcatctgttatataatgtaacaacaatggcaacaacctggcataccgttgccacacaggatatccgcctgctgaaaaaacagatggatattgtaaatgaacttccaaaagaatatctgtttttaaattatttaagatgccatgatgatattggctggggacttgattttgaaacactcaaagattatggaatggaagaaattgcacataaacgctttttaaatgatttctttaccggaaaaacacaaggaagtgtaagccgtggagaactctataacgatgaccctgtcacaatggatgcacgtttctgcggaacaactgcatcgatgtgtggaattgagacagcattaagagaagataatgctgaaaaattagaagaagcagtccgcatggatgtgatgcttcacgcatatatgctggtacagtctggaattccaatgttatacagcggagatgaaattgcccagttaaatgataaccactataaagaaaatccacaaaaagcagaagactcacgctatattcatagaggagcatttttgtgggaaaatgcaaaaaaacgaaaagagaaatattcggtggaagaaatcgtatttgattccctggcaaaattagagaagataagaagaaatgagactgtgtttgatgcaaaagcagacgtgtatacttatgatgtaaaagagaataaaatccttggaatcttaagagaagatgagaatacaagatttattgccctgtttaattttggaaatgagccacggacagcatggatgcaggaagaaggcgaatttgaagatttgtttacaggaaagaagattgagttaaaagatgtggaactggctgcacatggatttgtgtgggcggtgagaagaaaataagaataagagcaaaaagagaaacagccggaagagtatatatagaaactctgaccggctgtttttctgctcatagacagttccagtttgaacgattaaaagttaaaaaattttgaagcaaaaaatattcttcaaattccagtatgataatattgaactacaaaaaatattgtaaattatttttagaaaaaaatctagtagttatattatactggattaaaatatattgggtatttttgaaacaaaatatattaggaatatattgcaaaatagaaagtttaagagtataataaaagaaaaaaaggagtgatgcaggtgagaacagaacttgtttttgtgttaaaaaagccaatgataagtctggactatcgaagaatgattctatcatggttaaagcgaagtcttacagagtgtaatcagggaaaatattatgaacgatattttcggttagatgctccacaaaaagattattgctttactgtgctaatggattctccgaaatttacaaaagaaaagatattgttaaaagaaccaagaattcgggtaatattttccgcagatgataaaaatcggagtggattaatattttttgcggcgtttttagctatgaaaaataagcagtttccattaccggatagaaatgccatgactttacgaaatgtaataagaaaaaatgaagcattgattgcagaatcttccgttatctttcggaccagcctgggaaatgggttgtgtattcgagaacatgacagagaaacgaatagagataagttttttacctgtgaagacccagaatttaaaaagaaaacagaagagatactgaagatacaggcaagacttgctggttatccagaatctatggttcagacgataaaatttactccgattcagtgcaaaaaagtattagttttcttctatggtcgatatgtcgatgtaacgaccgggattctacagttagaaggagaacctgaattattacagtatttttatttggcaggagctggttcaaagcacagcgcaggctttggccagttgaacattttaaaataaatcaggaaggaggagaagttatgggactagagagaatagaacctctggattggagatattccgcagcaattgtaggactaaaagaatatctaacttggtgtggtgcatcagactggaagttacaagatgaatatctggaatataattcggaatctattacagagtcagattatttgaagtttgtggaacagaaatattcagaagatatgcatcatgtattagctgaagaattactattagaagaaaaaccaagtgaagaacagatgaaactgataaatgaaaagctgactgcaaatacagttttaaaaaaaatatttggaaaaataaaatacgatggaataaatcgggaacagatacaagaattaatagaagaaaatcgtgaagaaattgtaaaagagacctatcgaaataaagtaaatctgtaccgaaactattgtaatacaaatcaattatttgagccaggtaagaattgttgcagactactggggtattatgtagatttaccaaaaaaaggcaaatccatttcttataattttgatatggcaaattttgtatacgaggacactccgatatttgattttattccatttgcattttgtggagaacgagatttttattttataaatgataatgttgatttaagagagttagttaaaaccaataagatactgcaagataaaataaaaaaagcaagagaaaatgcaaggcaagagggaaaaacaattgattccagacagatttttttccagactattattgaatcaaaggattttatgtatcatgatattgagattatacataaaaacgttgaaaagacacattttgaaacattatatttaagtaaaaagagcctggatattttacagaaattaaatggagaaaaaacagacaaaaaaccatataaagcattttgttttaaaataaaaataaatgataattattatctggatgtatttaaagaaacgatgaactgcattgtgaatcttattttgacagatgagtggataaattatcttttaaaaaataatgcaaacggaaattacacttatgtgttataccaattaataaaagtaaatttatggataaaggaggatgcagatatggaagctggaaataaaagagcctatggatgtgcaaaggcagttgctaagaagaaagataaagtaccggacaacaaactgatttcgtttcgccaaaaactgacgagtgccttgacctttgaagattatgaccgattttgtgatattttattaaatttatcaaattatgcagatgaaccatttgattttgcatatgatttatttgaagattttgagaaaaataaagaattagcgtatacatttgtaacagcgctgagaagagataataaaaatgtagaggagacaaaagtatgaaaaagaattctttaacattaacggtagttgcaaatatgacatctaattattcggagtcactgggaaatattgcaagtgttcagaaagtatttaagaacagaaaaatctattctatgagaagcagagaaagtttaaaaaatgcaattatggttcagagcgggatgtatgatgatttagaaacaagtctggatggagcagcacagaaaaaagtaagtgaagaattaaatgcctctaattgtcgtgcgttagaaggcggttacatgaatacacagggaacaacttatgtaagaaaaagctctttttatttgacagatgcagttgcagcagagcattttgtaaatgaaactcgttttcataataatttatacttagcaacgaattatgcaaaagaacaggggatttccgtacagagtaatggtggaagtgcaggacttatgccatatcagtatgaatacgataagagtctgaagatttacagcatgacaattgatttagaaatgataggaaaagatgaaaatttccatgaagaggcagatgcaaaagaaaaggcagaacgtgtaatcgcacttttggatgcagtggaaaatttatctttagtcgtaagaggaaatctggataatgcagagccagtgtttgtagtaggaggattatccgaaagaaaaacgcattactttgaaaatgtagtgcatgtagaagaagaaaaattgattttatcagaagatttaaaaataaagctggaaaaaggatttcaggcgggacttttacgtggaaatttattgcaaaatgaggaagagatagagaaagaactggcaccggtatcagtacctgtattttttgaaaatctgagaaaacaggttttggattactatctggaaaaataaaagaaagatggtgtaaagatgagcaatttaaaaactgcagtacggataaaattacatcagacaagtgcgaattatcgtagagaagaaacaatagaaaataaaatgacttatcctcttccacctatttcaacagttattggggctcttcattcagcctgtggttatacggaatataaagagatggatgtcagtattcagggaaaatttgcttctatgcacaaagaaccatatacagattattgttttttaaattctaccatggatgacaggggaatcttagtaaaaatgagaaatgcatctatgctttcaaacgcttttatcaaagtagcaagtgcgaagaaatctcaaggcaacagttttttaaaagggattacgattgatgtacatagttcggagttattagaagaatatagagcacttaagaaacttggaacagaaatacaagactataaaaaaacagaatataaagagaagataaaagagtttaaagagaaaaaaaaggaactggcagataagaaaaaagcaattggaaaaggaaatgctggctttgaaactgtggcagaagaagaaaaagcgctaaaagcagaagagaaaaaatatcaagagacagttgcaagatatgaagaagagaactataaaaaaccagttgcaaaatttcgaaccgtaacaaaatcaatccgatactatgagattttagaccagatagatttgattatccatgttacagcagatgaagaaatcttagatgatattttggaacatgcttatgatttaaaagcgattggtcgtagtgaagattttgtggaagtattagatgtgcagaaagtacagttggaacaaggaaggagcagagtaagaactttaaatagtgcatatttaagttatgatgatattgttgctggaagaattagaacaggagctatgagtggtcggaagattgcaggtactgcctactatttgggaaagaaatatgatgctaccacaggtaaaaggatatttttagataaaaaaagggttgtttatacatctaattttaatattgatgaagcttctggaaatgtttggatagataaaacagagaaaccattttatattgtgaattttttataataattaataaagtaagaagtacagaaaaggcatggcagaaaggaatcttgttcatgtcttttctgtttagggagaaagcaatatgaaagcaatacaggattttttagcaaaaccaaataagacaattcgggaacattcagatgacttgaagaagcgagtatattatttgaaagaaataggatatataaaaggagaacgtttgttttatcttttattggagtgttgtaaacatcatgatgatggaaaagcgaatttttcctttcaaagacgtgtatccagtaaaagatggattccgtttgatccagaaaaagaaataccacataatgtattatctgtgtattatttggataaaacacagtatgaagaaatggattatttaaaaattgcgagtgcaattttatatcatcatgattattgtgatgaagatagagtgataaatgagaaatggatgttgatagatgaaaatcttttagaaggttatagcagtgaatctttaagcggagatgaaattgaatatttaatgaatgaaggactttatggcgaaaatcttatcatattaaaaggtcttttgcgaagatgtgattatagtgccagtggagaatatgaaattgaatatccaaatgattttttgcttgaaaaattagaacgaatgatgcaacgctggaaagaaaaaaatgaaaatgctggttggaatgagttacaaaagtttgcaatagaaaacagggaaacggatataattgcagttgcgtccactggaatgggaaagacagaagcaggtcttttatggataggagaccaaaaaggatttttcatactgccggtgcgaactgcgattaatgcgatttatgacagagtaagagaagaaattcttcaggaagaaaagcttgaagaaagagtggcgttgctacattcagaagcattggaatattataatgataatgttgaagaacttgatattacggaatattttgaccgaggaaaacatctttctttgcctttaagtatttcgacattagaccaattatttaattttgttcttcgttataaaggctatgagacaaaattagcaactttatcatattccaaaatagtaatcgatgaaattcagatgtatgaaccagatttactagcagtattaatccgtggattaggacagatacatagattgggtggaaaaatcgcaattgttacggcaacactggctccttttataaaacagcttttaaaagaggatgctgaaattgaatttaaagaaaaagattttattttagataaaacacgtcatagtgtgagtgtaaaatatggtgcaatacaggcggaagatattgttacacaatatttggaaaataagaaatctggaaaatctaataagattctgattgtttgtaacacaataaaaaaagcgcaggcactgtatgaagaattaaaaactcagttgggagaaatagaagaattaaatttattccatagtcgttatatacgacaggatagaaaaaagctggaaaaagaaattcgcagatttggaaaaacatattgtgatgaaaaacataaaatattagattgtcagaatggaatctggatttctacgtcacttgtggaagttagtttggatattgattttgactatttatttacagaattatctgaactaaacggtttgtttcaaagaatgggaagatgtaatcggaaaggtgtaaaaaatctggataaatataactgttttgtttattgcgcaggagaagaagtaaaaagaggacaaaaaggatttttagacccaattttttatgaacaatcaagaaaagcgttacaagaagtggatggacttttaagtgaagagaagaaaatggatttaattaatcggtattttacgatggaacaggtaaaagacagctcatttatgaaaaagtatcgagaagtttataatcaacttatggaattgcggattggtgattttgaggaaggagaacaattaaggagtatttttaatcaggatattattcctaaattggtatttgatgagaatagggagtttattttagagcagcaggaccgattaagaaaaatagaaaaacagcttagaaaaagtaaaggagaagaaagagtacagtatttaaaggaacgattaaactgtcaacaaaatttaaaagaatttgtagtttcaattccaaagtatgaataccaaaactatatggaaaaaatctgggaaagatttggatacgttgtaataagtaaatatgaaaagattccgattatggattgttattatgatgaaaaagggtattatccattaaattataaagaaaggacaatagaagatgaaatgatgatgtgttagggggaaatttatgaaagaaaaagtaacaggaactatggtttattattattttgtctgtgaaagaaagctttggtattttagtaatgaaattaatatggaaagcgaaaatgagagtgttatattaggaaagctattagatgagggcagttttaagagagatgaaaaacatattaatattgatgacacaattaatattgactttattcgtgaatataaggaactgcacgaagtaaaaaagagcaaagcaattgaagaagcaggtgtctggcagacaaaatactatttgtattatttgaaacaacggggtgtaacaggattaaaagcacggattgattatcctctgttgaaacagcacttagatgtgacattgaataaagaggatgaagaaaaaatgaagataatattggaagaaatgataaagatttgtaaaaaagaaattccaccagaattttcatctcaaaaaatttgtaagaaatgtgcataccatgatttgtgctttatttaggggaggaggtatttgattttttatgaagcagagtttttatgtatataataatggagatttaaaaagaaaagataatacactgcgatttacttcgtatgaaggacaaaaaagagatattccgattgaaaaaatctccgacatttatgtgatgtctgaaatgtcatttaatacgccattcattagctatatttcccagtatggaattacaatgcatttctttaactattataattattatgtaggaagttattatccgaaggaaagccttttggcgggtcagttgctgataaagcaggtagagcattatcaagattatgaaaaaagattgacattagctaaaaaatttattgaagcagcagcagataatatttatcgaaatctgcgttattataaggcaagagaaaaagatgttttaggtgctatgcaggaaattgattatttaaggcgacagctatcaaaagcagaaacaatagaagaattaatgggaatagagggaaatatccggaaaacctattattcagcctggaatgaaattgtaaatcaagaaattaaatttgaaaaaagagtgatgcatccaccagataatatgattaattctttaatttcatttgtgaattctctgatttatgcaaaaacattaagtgaagtgtatcatactcaattgaatcctacgattagttatctgcatcagccaggtgcaagacgtttttctttatgcttggatttatcagagatttttaaacctcttatagcagatcggttgattttttcattacttaatcgcagacagattacggagaatagctttacaaaagaatttaattttcttcacttgaagaaggaggcatcacagttaattgttacagaattagaagcacgtttgaaacaaacaattatgcatagagatttaggaagacaggtttcctatcaatatttgatacgcctagaagcatataaattaattaaacacttaattggcgaaaaggaatatgaaggttttcggatatggtggtgatagatagatgtatatcgtgttagtgtatgatatcagtcaagacgaaaaaggacaaagaagatggtcaagaatatttaaaatatgtaagaaatatctgtctcatattcagaattctgtttttgaaggagaaatatcaaaagcacagttggcgaaaatgaaaaatgagttaggaccttacataaataatgaacttgattcagttattatttttaaaagccgtcaggaaaaatggttagacaaagaatttcttggtaaggtagaggataaaactggatttttgctgtaaaaaaattgtcgacctccgataatgtaaaaatatggggaggtcgacaattaaaagaacgtaggaaatgcaggaaaagatgaaaaagaattaagaggaaaatcaaaaatttttgagaaaaagtgagaggtcgacaaaaaagggttgaaaaactaagagaaaagtagtagtgtataggcacggatattaatagaatcacagtggaatttaaattgccttacccccgtttatccggctgggctttcgcccatattaatagaatcacagtggaatttaaatgcctttacgccctgcctcttaagcaccgctgctgatattaatagaatcacagtggaatttaaatgcttttatcaatgcttcaattctgatccggtctgcatattaatagaatcacagtggaatttaaattcctttgttatttttccggtcttcccgttaatcacaatattaatagaatcacagtggaatttaaatgacaagatgagtccgccttcgtcaacttcatcacctatattaatagaatcacagtggaatttaaattattatgaaagattagaaaaggaaggtgaatattaatattaatagaatcacagtggaatttaaatacatcacacagacaacagttcattgtgtccaaccttgcatattaatagaatcacagtggaatttaaattgaagaagcaaaggaaaatgcatcacagttgattcaatattaatagaatcacagtggaatttaaattagaaaccaccttcacaatactgaattgggtttgtatattaatagaatcacagtggaatttaaattaaacctgagcacctccataaacctgagtatcatcaatattaatagaatcacagtggaatttaaatgtcgttacggttacttctgttgttataaagcttagtatattaatagaatcacagtggaatttaaatggaaaactcatgataaactcattatcttgatacaatattaatagaatcacagtggaatttaaatgacggacgtatcgaatagaaaacaagagtaccgtatattaatagaatcacagtggaatttaaatgttaaccatgttgcgccatctgcgcccttagctccggatattaatagaatcacagtggaatttaaattaacagcgatattgtttaaatttaactaattatttatattaatagaatcacagtggaatttaaattgggtcaaactgttccaatgattcttctacaacatatattaatagaatcacagtggaatttaaatgagattaaacgtttcttaaaagaatcatcttcatctcatattaatagaatcacagtggaatttaaattcatttctcttaactgctgttccgacactgtacagatattaatagaatcacagtggaatttaaataccggacccatacgcctaaagagcaggattaaaaaaatattaatagaatcacagtggaatttaaatgttctaaagatgattaacactttaatcggtcgacttaatattaatagaatcacagtggaatttaaatgcaaatagcgtgtttgataactatcagtatgaagtacaatattaatagaatcacagtggaatttaaataccctcacgttttgatacgggttcatgaggtctgtgcatattaatagaatcacagtggaatttaaatcatatcatcaaattcaggcggtttgactgtcgcttcatattaatagaatcacagtggaatttaaatttgcaccgccctcaactgaaaggaatctgaatacaatattaatagaatcacagtggaatttaaattgtagaaattgcctcaccagtctgcacaatgtcctatattaatagaatcacagtggaatttaaatcttgtagatgtcgaaacatgggataaagtaaatagatattaatagaatcacagtggaatttaaattttttcaatgtagaacactttgacctcatgggttctatattaatagaatcacagtggaatttaaattgattcccccgccgttttcttcataggcggttttcaatattaatagaatcacagtggaatttaaatccctacctcaatcttaactattttcatccacaaaaaatattaatagaatcacagtggaatttaaataatcgtattgagtcaaattgtaagtcttaatctgaatattaatagaatcacagtggaatttaaattctaactgttgaagtacctcttcaattccggcataaatattaatagaatcacagtggaatttaaatttgcttgcgatgccaataacatctttaaactccggaatattaatagaatcacagtggaatttaaatgtatacttcactttgtcaactaatgttacttcaacatattaatagaatcacagtggaatttaaattgatgatggttttgatgttcatatttacattcataaatattaatagaatcacagtggaatttaaattgtgatcagggcgaatacagaataacggcaggcgaatattaatagaatcacagtggaatttaaatttgatgacaatcttcaatggtgcttgttctttcttatattaatagaatcacagtggaatttaaatttatttaattttgattcataattatcgagccattttatattaatagaatcacagtggaatttaaattttcgaaatttccatgctctcgttttcgttcggcatattaatagaatcacagtggaatttaaatccatttgtattaaaatgcagttcaattacatttgtatattaatagaatcacagtggaatttaaattcattttgatatatctgcaaatcaatacttctttatattaatagaatcacagtggaatttaaatgtaacatcccgcagtatcctgaaaataatctgtaataaatattaatagaatcacagtggaatttaaattctggcattgcagtatcaagttcaatgttatttacatatattaatagaatcacagtggaatttaaataagtgtatcaacctgatcaggtgtaaacggtgatctatattaatagaatcacagtggaatttaaattttgaagatgatctaatttaacatcaacgaagcgcaatattaatagaatcacagtggaatttaaattgatttataaggtggttacggttgtctacggttaaatattaatagaatcacagtggaatttaaatttggcaagattttcacctctattcgtttgttttgaatattaatagaatcacagtggaatttaaattcctttcctgcccccttttgagtgtgttcattgtttatattaatagaatcacagtggaatttaaatcatttcgccatctcgattctccagcgtttctaatctatattaatagaatcacagtggaatttaaatacacaagaaaaaacagtaaattatacaaatcagagtaatattaatagaatcacagtggaatgtaaattcgttcttttctacattgtccaagaactctctatattaattgaaacatagtggaatttaaattctgtcgctttgcaaactacgaaatcgcatggtacaatattaattgaggtgtagtggaatgtaaatgcctttttcgttggaataaaattaacgatatataaaaaagtgtatattatagactaagagaggtgaaaaaaatgcatacagatgttagagaatatataagattgtgccgtgtaaaaaaaggaaatatggcagaggctgaacttgctaggagaacaggacagacagcgcaaaatatgaataataagtataaacgaaatacgtttaaaatttcagaactacagaaagtggcagaagccctggatgcagagttgaagattacatttattgacaaagaaacaggtgagccgattatataaaaatatatctgataaaaaagtattgaaaatatataaaaaaataatatataccgattatatcggaacgggaaaggcaaccgatataataagagaaagagaggtaaatatgaacgtgaagatgtcagaaacagcaagacttatcttgggcttgcgagaaagagggatgagcgatacagaaattacgaacttaattttatttgtagagactggagaggagcagtataagccgaaaaaagaaagcaaagaaaaaaagttaaatagaaaaaatcggtcaagggtagaaaaagggtagaatttgccgccacctttgctagaaaaataataacagaaaattagaaagaaatcatattaatcgaagcagagtggaatgtaaattacgttgatgccgtactttttgcaaatttgtcgtttacgaaaagtgaggtagataaaatgctgatacaatccgcagaggaagaattaaaattttatgaaaaattagatgctataacaacaaaagaagaaagattgaaagtagaaaaagagttaaaagataaaagactatcttttaaaacgagaagaagaattaaaagagtatccatttgctcattgatactgccgatataacgtctattaagagaaagataataaaatttaaagcagaaaggaagaacgaggtgaagtatgagagcagacgatgaccttacatatcaggaatataaagatagtgtagaatctaatatgagcctaataaaacattctggatggactccgaggcaggttactgactggatgacagaggaagataatgaattatttgtcggaacatcagaagcactttggattatttccattggtgcttatgaagtggagcatgatatcttagaagaacgggtattagaacagttgtcatatcacattccacgttatgagatgggaaaatatgacgatattacgccggaggaaagaaaacttttggaaaaggatattgagtatattcgttctaaagtagaattgtggaaattaaaggattatgattagcgataataagtaaagtattaagtaataaatcatcattaactgatggataaggattagtatatattgataaagaatttgaaggatggatgccaatgtgcaaatttgaattaagtcaagaacagattgaatttttaaagaaagaatattcagaaaataatttgatacagaaagttctggaaacagagaaaaataaagtttttgaggtagatgtagatactaaaattgattttatggattttgtcgaagacgaatccatatattggatggacgaggactacgaggctacaccaaagactattatgttggagtcaataagagatactatatactatcaaacaaattgaggatagataggtttaaaaatattgaggggcgtatacataagtggcataatgttcttatcaggaggttggaaaagatgagaaaatataaaaaagaaaactaggataaaacctatctattataaagtatgaaagcattaaattttttaggaatattttttattagtattggaattgtaaaatgtagtatttatttcatattaaagaaatgtagaagatattagttatggaagaaaagaaagtatgtccgcaggataggtgggacaaaaaagcaggcgttgtatctaaaacttataaggttaatgagcagattgcaaaggagtatcagcttgcttgtaaaaaagcaggagtagcaatgggaacgcagttaacgaaaatgatgagcgcatttattgaagaagtgaatcgtgaggaataaaagataatgaaaaaaatattttatccggcaatttttcatccggcagaggaaggcggattttgggtaacgtttccagatttaccagaatgtataacagaaggtgataacatagagaaagcgtataatatggctaaggatgcacttgaattggcgttgacagattatataaaagaaaagaaagaattaccaaaatcatctgatattagtcatatcataatcaaagaagatgaaaaagttatgaaaattcaatttaatcggtagcgaagcagattgcaaatatccgtttggctcaaagtggaatataaaattgttgcagttacggccaataagagcaacagcagttatgctaatagattcataatggaatgtaaacgttgatgctgaaattatccagagcgcagcagtgccgtatattaatagaatcacaatggaatgtaaataacgctgtcagtgtatctattaccatgtctgttatatagttttaatcccctcaaactggaatattaaaatattgtgaaaattgtattacatattcagaaaatttttaaaattaagatttattaagactaattttcttgtcgaatcccttcaattatgatataatttctgttaagattacagactatttaaaacaagtaatgaaggtgaaaaaataagatgtttgaacacaaaaagataaatacattaaatgattttttcatagaacttcataaaagaccagaggaaggaatttatttttaccgacttaatggctattcgaatgaaattaaaacttttattcaaaattactacgaatccgcaagaagagccggagttgtaattgagggaaaaattccaaatccggatgaaaaaaatctggcatattataatgaaatcatgggaatggattttcagatgaatccggcatttattgaagctgcacttaaaaaatggcttccaagaatgaatggttttcagagaaaaaatgttgcatattctatttatgatacattagatagtttaagaaaatccggaaaaaatgaaaatatgctcaaaaatgcatatattaaatttatgtgctggctttattataagtttgagaggattgtgaatctgcttggaacagagaaaatacccaaaattttgtatgagggtgaaatcagtcagtatgaactgcttttaattgtggtgttggcaaaagccggatgtgatgttgttttacttcaatatcatggagataactgttatctcaaattggattcgaccagtcagttgtccgaggaatggaaagccccagatctaacaaattttccagctgattttagtttgaaacagttaagaacacagatgcaggaagcgtttgaacgagaacgtttatatggaagagcttcttcttataaaaattgtacaaatgcgtggatagagggaaaggctttagaggatatacaaaaagatgtctcaacgagaggggcagataacagcttcttttataattgttattgtctgataaatggagtggaagataagctgacatatgcaaatcaattgtttttgttttaccaaagcatagcagaaagtaagcgaaatctggttgcaatagatgagaaaattccacttccacagccagaggaaatttcatctgtcagaagaaaaaattatatgaatttagaacagatgttattggatttatcttttaatttaaaagttcctgaaaatgtagaattgcagagactattgataaaagcgtttatggatgtgatgttttcggagagtaaaaagtcaggagtgaatttaaaccgtttgctgaatcaggcagtgtatctgctttgctggactaagagatatcaaagtatactatttaaaaactggaagatgcctgagattgcctgcttcttttatatgacggcgcaggttacagagaatgaagctctttttcttcggatgttggcgagacttccggtagatgtattgattttaaatccacagagaacaggaaagggagagttggaagatcctttattatatgaagaaaattattctgaaactttgaatatcaaaaaaattccaagggaaaatgtagatgttcagatgggaaccgttgcatatcaggcggaacgagaactggatacgattttatatcaggataccggaatttatcgaaatcaacagtatcaaaatgctagtgtgattaatttaaaaacaacgtacgaagagattggaattttatggaaagaggaattaaaatatcgtccgaatttcagtactacacaggatattgtcaatcttcctgtgatttttgcaaaagtgtgtggcataaaaaacggagatgaaacagcatattggacttcaataaaagaattaattacagaaaatacatttgtagtaaagcattttccttttttacaggcaacggatgaaaacctaatgaagccttatgcaacagaattttggaaaaatgagagacttcataaaaataagataaagaatcatccgagttatccttatgcaatgcttcgagaggagatgcaggattatattttagataagctggagcagttaataaaaagcagggttattagtggaacatttaaaaatgggacagagtatacgattgtatcgacggttttaaatctgccaaaggaagtagtaaggctgttacaggcatttgattttacaaaagaaaacccgaaagcggttctgattcacacaggagaaaaaatgatttcactggaggataccattttaaccgcatttttaaatctggcaggatttgatgtggcgttttttgtaccaaccggttatcagagtattgaaaaatattttaatcgtaaactatttgatgaatatcagataggagagtataaatatgatttacaaattccggattttaatcattttctgggaaatacatgggtaagaaaatggcgggataaactattaggaaaaggagtatgaggtatgggacttgattttggaaaaccagagacaatgacaggttctgttattgttccggaaaaaaatgagatagaagaggtaaaacaatatgatattgttgcagaccgtcagcagttaaatacgacactcaccaactcaaaagaagtagatgatattgtcagtacaattgaagtctataatttagacacaattgtatcgtttggttctgaagttgcagaagaaatttctcgtgcctctgatgttgtgttaaataatacaaacatgtcgcaactggatgattccagtgaattgttgaatacactcacaaaaattatgaatcagtttgatattgatgagttgaaagagaatccgggtctgtttggaaaattgtttgggaatttaagaaaacagctggataaaattatagataaatatcataccatgggggatgaagttgataaaatctatgttcagttaaagaaatacgaagcggaaatccggcaatcaaaccgaaaactggatgaaatgtttcaggcgaatgtcaattattatcatgagctggtaaaatatattctagcaggagagcagggctgtaaggaaattgaaaattatatcgccgagcgtcaggcggatatggaagcaaccggtgatcagtcaattcagtttgaaattaccagtctgaatcagtccttaatgatgttagagcagagaactcaagatttgcgtacagcagaaaatgtggcaatgcagtccattccaatgattaagaccatggaatttagtaatatgaatctggttcgaaagattaattcagcgtttatcattacacttccggtattcaagcaggcacttgcacagacaattatgttgaagcgtcagcgtgtgcaggcagaagcaatgtcggcgcttgaccagaaaacaaatgagttattaatgcgtaatgcaagaaatactgtagagcagtcaaagctcacggcacaattagcttcagggagttctataaaaacagaaacactggaaaatacctggaagacaattgtaaatggaatagatgagacaagacagattcaggaaaatgcaagaaagcagaggattgaagaccaggcacgattggagacaatcaaacaggaattcaaccagaaatatcatatgccgaatcagtcgtataaataagattgaaaataaaagcgcaaggaggaaaaaacgatgccaattaatttatcaaaaggacagaaagtagatttaacaaaaggaaatgcatctttaaagcatatcatggtaggacttggctgggatgtcaatgcttttgattcaggttctgattttgacttagatgcttctgcatttatgtgtggtgcaaatggaaaatgcccgacagaaaaggaatttgtattttatggaaatttggagcatccaagtggagcagtaaaacatcagggagataatttgacaggtgaaggcgatggcgatgatgaacagatttttgtggatttaaaagcgattccggaaagtgttgataaaattgcctttactgttaccatttatgaagcacaggagagaagacaaaactttggacaagtttccaatgcgtatatccgaattgtagatgaggataccaatcaggagttaattcgttatgatttaggcgaagatttctcaattgagacagcaattgtggttggtgaattgtatcgtcacaatggcgagtggaaatttaatgcaatcggaagtggatttcagggtggattggctgcactttgtggtcactatggaattcaggttgcgtaaaacagaaacagtagtttaaccaaatcaagtaagtcacctgcttcaattgcgaaaagcaataagcaggggtggggacttgcttgtatcaggagggggggtaagccccttttgataagctgcgtagcagctatttggttatgagcaagtagcgaagcggattgcgaatatccacttgacaattgttttaagaatatattaaaaaaatacaggaggaaatagttatgccagttagtttaaaaaaaggacagaaagtgagtcttacgaaagataatccaggattaaaaaatgtagtagtcggactcggctgggatatcaatgtgtttgatacgggcggagaatttgacttggatgcagctgcttttatgttaggtgaaaatggaaaagtaacaaagtcggaagattttgtattttatggaaacctcgttcatccgtcacagagcgttcagcatatgggagataatcgtaccggtgcaggcgagggcgatgatgagcagattaagattgatttaacaaaagttcctgctgagatttctaaaattgcgtttactgctacaatttatgaggcagaagcgagaagacagaactttggacaggttgccaacgcatttatccgaatttacaatgaagagacaggggaagaactgcttcgttatgatttaggtgaagatttctcaattgaaaccgctgttgtttttggtgagctttataaaaatggagcagaatggaaatttaatgcaattggaagcggctatcaaggtggactggctgcgctttgtggaagctttggagtggatatagaataagaaaagacaataaaaagaaaaaaatagagtcaacaggaggacaaagatatgtcagtcagcttacaaaaaggacagaaagtaagtctgtcaaaagataatcaggggcttgcacaggttattgtagggcttggatgggatgaagtaaaaagaaaaggcggtttgttctcaagaaagccacaggcaattgattgtgatgcttctgcgattttattaaaaaatggaaaattgtgcggaaaagaggacctggtctattttggaaatcttcgtcataaaagtgatgcagtaatgcatcagggagataatcttacaggcgccggagatggcgatgatgaacagattatcgtagatttattgcggattccacaagaatatgatagaattgtaattgttgtaaacatttataaagcagtacagagaaaccagcattttggaatgattgaaaatgcatttatccgtattgtggatgcacgaggaaacagagagttatgtaagtataatttatctgagaattatgatggaatgacagctatgatttttggagaaatttatcgtcataacggtgaatggaaatttagtgcagttggacaggcaaccaaagatccaggtcttggagagcttgcaaatcgatttgtttaaccgaatcaagtggtgaagtggattgcgaatgtctgcttgaaaacgtaaagcaatcgggtatttaggaagagaagctgtaagtccggtttctctttcttttatactataaaaaactcaaaaaggagacagaaaaatgaagtacaatggtttatcagacaaggaagtcgaagagtccagaaagcaacatggctcgaatatgattcctgattcagaaccaaccacattttgggatgaattcaaggaaacttttagtgacccgatgattaaagttctgttagcaattgcagcccttatgattgcaatgtttttctttgggtatgctgagatttatgagccattaggaacgattgttgcagttttaattgttgcgtttgtatctgcaaagacaggtgttgccagcgatacaaaatatcgtgagttgaaagagagtacagagaaagataaatgtaaagttcacagaaacggtgtaattaccattattgatgtggacgatgttgtagtaggcgacaaggtacttcttcagtctggtgataaaattccggcagatggtatcttaattgatggttctcttcgtgtcgataactctgcgttaaatggagaagcagaggaatgcaagaaaacacaggcagatgaatcattccagcttgcagatgaaatcacaggagataccttcgtagataaacattctcttttccgtggtgcaattgtatttgatggagagggaattttggatgtcagaaaagtcggcttgaaaacaatgatgggaaaaatggcagaagagatgcaggaagatgagccggattccccattaaaagtaaaacttgcgaaacttgcaaaacagatttctacctttggatatattggtgcaattgtaattgcagtgctctattttgcttattttattgttttggcaggaggtccgtccgcttattttgcagagggatttgaaaatattttaaaagatttaattcaggcggtttctcttgcaattgtaattattgtctgtgcagtacctgagggacttcctcttatgatttctctggttttgatgcaaaatacaagtaagatgcttgaccataatgtacttgtccgtaaagcccagggtattgaaacagcaggttctttaaatattttattcagtgataaaacaggaacgattacaaaaggacgactggaagttgttgatttcttctttggagatggaaaatcggttgctcttagtgagttaaaaaatcatggaaaagtaaaagggcttgtggatcttgcaattggaaagaatacgcagtctatgtttgatgcatctcataaagtaattggtggaaatgcgacagaccaggcattgatgaaatttatcggagaatctactttccgtgcacttgaaagtgataaagagtgtgtaattacacaacagcagggatttaactcttctaataaatttagtcaggctagaattgaaagtcttggaaagacattttataaaggagctccggaacgtttattgggagccgcaaagcattatctggatgcagacggaacagtaaaaccgctggatatggatgtagtaaataaaaagattgatgagttggcagtaaaagcaatgcgtgtccttgcttttggatattcagagagaactatgacggaaaataaaatcaatgatgatgttgtaattattggtttagttggaatccgtgatgatgttcgcccggaagcaaaagaagcgattgcagaagtgcagggtgcgggaattcaggttgttatgattactggtgaccgtctggaaacagccgttgcaattgcaaaggatgcgggtctgttaaaaaataaagatgataaggcactttcttctgcacagttaaatgagatgagcgatgatgaagtaaagaaaatcattcctcatattcgtgtcattgcaagagcacttcctacagataaatccagaatggttcgtctgtgtcaggaaatgaatcttgttgtgggtatgacaggagatggagtaaatgactctccggcactgaaacgtgcagatgtcggatttgcaatgggaagtggaacagaagctgcaaaagaagccggtgagattgttattttggatgataactttaaatccattaaagatgcaattttatacggaagaacgatttatcataatattttgaaattctgtaaattccagcttgtaatcaatgtgacggcagtagtggtcagtgcgattgcaccgttctttggtgtagaagaaccgttaaaagtaactcatttactgtttgtaaaccttgttatggatggtttgggcgcaatcatgcttggaaatgaaccggcacttgagaaatatatggatgaaaaaccaagacgcagagatgaaagcatcatcagtaaacagatgatgggacagattttaacaatgggtctttggcttacggttgtcagttttgtgtatttgaaagcaccgttctttaaaaatttatttgaaaacgaagaacagcatttaacaggatattttgtattattcatcgtaagtgctttgtttaatggatttaatgtaagagatgacggagctgaaattttcaaaggactggatttaaatccaggattcttaaaagtgttctttgcaattattttagtacaggcagtgattgtaaatgcaggtttgattccatttgtcgtatttgattggattggtgaaatgttcagttgtgttccatttggaattaagggctggattgcagcgattcttttagcggttactatgataccggtagatttaatccgaaaagcaattgtaaataaaaaacattaaaataaaaagcagatacatggaatcgtagaggattccggtatctgctttttaagcctaagattaatcgattccaactcggattccaccgattctttcatttggctgaactaaaacagtaactggctggtgggaattccactcataagagtaagattcaccggaagcctgtccgataaagtttttccatgaaagatccgttttgatctgcggatcacagtatccacgctgggagaaccagcaaattacggcatcagggtctacacagagagtggaattactgtttacattgcttaaaacgattggatttccattgcaaagcagggcgacataagcatttggtcctgttcctgttaatgttgatgtggcaagtcctttttgagagaaaattccacagccgatgaagcgcacctgataattacagtccggtgtaaaggcaagaatattttcagattctacagaaacaacttctcccggggcaagctggtaaataacgacatgctgacctttatctgcataataagtgacagaatctccattcatggtaactttcataagtgggaagttttcaccggtcgctcttctcatcaatgagccaaaggcagcttgcgcaagactttgttgtggaccgagcagtactttttcaaaacgataatttttgtttcctgggttatctccggcaataaaagcgccggcttttacaaaaagtgtatcagaaccagaacaagttacttttaaagataattcatttacagtttcaaatgtaagcatagcaaagttcctcctaagtataagtgagtgtagcgtgagctgaggttaaatcgaacgcttatgatacattaacaccataacgtctgcaaagcccggcaaggtcttcttttaccccatttccaacagcatgaaatttccagataccattatgcagatagatttctccaatcatcatagaagtaacagattcataataatcactcattggaaagctgactaattcgtgttggttagaatctataatctggatatacgcatgttcaatcatactgaaatttaaatttcttgtaagtgcttcgtttatagttaatacaaatacgattttttgcacaacggaatttaactgatttagctgaatatgaattttttcgcattgattggttgaaagcgtttcaaatgaaacagatcgatcagggctttgtggctgaccgtaaaaaacaaaccaggaatctcctaagactttttgatttgctcctaataaaaatgcagagacatccacatcgcaggcggttttttttacgttccatcctagtagaatgtcgacagatggagaaacagagtttgtaaacagtgcaattttctgacctttttgtacgatgtttttaaaagtcggatgcctgtaagaagcaatagtgggagcgggtgaatgagagcgcaaattttggtttaattgtaaaattgtctgagaggactttgcggttcgtactttttgggtattcagcgacaaaatagtctgtgaatgaaaggcaggtattgttttttcaggaatttgaatcataagaaacttcctttcttttttacatctttttaaaatcatagtagcattttagagagaaaaaagcaatgaaacagcagagaaattgacaggaaatattgagtttctcttgtgggtatagtatgataaaaaacagaaaataaaagaaataaaaagaaaaataatgaggataattatgaatccaataattgagataacaaattttgaatttccagaactggatgtttatgcacgactgaatgaaagccagcttttacattttaatgagccaaaccctgggatttttattgcagaaagcccaaaagttattgaacgggcattaaatgccggataccatccgatttcttttttaatagaaaagaaagagataggagcacaggcagaagaaattttctcacgatgggaatctgttccggtttatacagcagaatttgaagtgctcaaacagcttacaggctttgggttgacaaggggaatgttgtgtgcaatggagcgtttatctttaaaaagtgtagaagaggtctgcaaaaacgcaagaagaattgcagtcttagaaaatgttgtaaatccaactaatgtgggtgcaatttttcgctcggcagcggcattaaatatggatgcggtattattaactccagcttgcagtgaccctctttatagaagggctgcccgcgtcagtatggggacagtatttcaagttccgtggacattttttgataaaaagaaagtgagctggccggatggaggaattcaattgttaaaagaaatgggatttcaaacagcagcaatggcattgacggatgattcggtcagtattgatgataaaaatcttatggcagaagaaaagcttgcaattgtgcttggaacagaaggagaagggttggcaaaacataccatcgcaacttgtgattatacggtaaagattccaatgatgcatggtgtggattcgttaaatgtagcggcagcaagtgcggtagcgttttggcagcttggaatggcaaaaacagatggttgttgaataagaaaatctatgatacactaaaaaattgagagaaaagaaagagcatagataaaggagaaagaaaatgccagtatttgactttagtgatacaccaaatgaaaaaaaagacccggaatgtacttatgaggttttttattcaaatgaatcagaagcaacaccggagaaaccaattttaattttagataattctgcccgtcagtggaaacatcattccggcggaatttttaccaatccaagtaagcgtacgacgtttgagttcaaagaagaagatggagttttttcggcagatatcttagagattgatgctcgttttacaagtcttttacgctggctgggagaaaaccatatcaatgtccggctttccggaaagaatcaggagaatggttatgctgtctataagattcgtgaaactgcttttggaggtggaacaaaactttcagcagaagacggatttctccaatttatgattgaccgtttgttggcaagtgatgcgccggcagaggaagtcagtgatgaagaagaggaagaagtcggcgatgatatgaaactgaccagtattcagagtattacagattttatgaactgtgcaggaaagacgatgccggataatatccgtctctgggccagacgaaatcttgcagttgcacgttctcatgaagtttcaccggaagaaagacgccatgcacaaagagcgctttctattatgatgaatattcagtggaagagtaattattttgaatccattgacccggaagaagctcgtaagattttagatgaagaactttatggaatggaacgtgtcaaacagagaattatggaaaccattattcagattaatcgtacgcatacacttccagcttatggtctgttattagttggtccggcaggaacaggaaaatcacagattgcttatgcggttgcccgtatcttaaaattaccgtggacaacacttgatatgagttccatcaatgacccagaacagttaacaggaagttctcgtgtttatgcaaatgcaaaacctggaatcatcatggaagcctttgcgatgtcaggagagtcaaatctggttttcattatcaatgagttagataaagcagcatccggaaaaggaaaaggaaatccggcggatgtgcttttaaccctgcttgataatcttggatttacagataactatatcgaatgtctgattcctactgtaggagtttatccgattgcaacggcaaatgataaatcacagattagtgcacctttgatgtctcgttttgcggtaattgatattccggattatacaccagaagagaaaaagattatcttctctaaatttgcacttccaaaagtgtttagaagaatgagtatgaaagaaagtgaatgtattgtgacagaagaagccttagatatggtaattaaactgcatgaaaatacaagtggaattcgtgacttagaacaggcagcggaacatattgcagcaaatgcactttatcaaatcgaggtaaatcatgtatctaaagtagtatttgacgctgaaatggtaaaaaatctgctgtcataaaaagaaaaatgaaacaattaaaaacaagaatgggtacatttgagattgatacatacaaagttccaaaagagtatcagtgctatggcatagagacaatttcgagaacaaatgacacacattggagtgtctgcacaatcagccagtctgtgaaggtgaatgacaaagtttatagtcctgttttatatcaaagctgtatgcatccagaacaggttacgatttatccacttaaagtagaacaggatggagagaagataacgtttgtcactcgttatgataaggcagaatataatctgaaagaaaaagagataaaagccgaattttgtatgtggtatccaaagctaaaaaagaaaagatgtaatccatgtcaaaattgtggaagatgttaaaaaaacggtcatttatgttagttaaatggccgtttttatggaaatggagagtataaaatgattacgctaaacgattatctatatgatggagatacgatttttcgcattttgcaaaaatatatcgatgatttaaaaaaaagtgcaaaagaaaatcaaaatgaaattgaccggattcacagtcattttttaattcagattcgtgaactccttgaacataatgatttcttgacggcacagtcccagaaaatccgtgaattttataaatatatggcaaaggaatatccatatcttgcttttacttttaagggaagaatcaaatctttgattcgggcggaggaaaaattcaacagttatgtgatggaatatatttatgaatattattccgaacatcaggtttatccgccagtctccgaattaaaaaagaaattaagctgttttcgagatttgattgcctatcgaattgtaatttctatgccgaaatgtcattttaaaagtgaacaggaaagaagagatgctgaattaaactgtttgtatgagattgcaaatgtactgccggaatttttagaggagcgtggatttacagcagagcctgcaaatggtgtgcaggaaagttgttcatctttattaaatccggaagtgaagccttattacagggattatgtatctaatcatgaagaaaatgagtatcagtctcttcacattacattttatgataatagttcacgaagttatatggaagtacagcttcggaccaagatgatggatgatgtggctgaaattggagcagcaaatcatcgtgtatatgaaaaaaagcaggaaaaagaacgaagaaaaagaaaccagattccgaaaggcgaatgtctgtattttgatgaggcatatgaacgagggatgcgtcttttggaactggatttatcaaaacttgatgtgaatatgttctcagcagttgataacaggttgattaatgatggatgtggattgtacagaggacgcttgattcttccttatgagcatttatcaagatttcaaaatgatttaattgactaaaaatgggaataaaaagaggataaattatgcagactgaaaaaagaaaaagttcagaaaaacaaaagataagaggtttcttatttgcattgtctgggggaattttatggggattttcaggaacatgtggacagtatctgtttacatttgaagatttaaattcggaatggctgacggtaacaagaatgttatttagcggaattattttgcttggtgtatctgccatcagtcatcgggaagaaatgactgcagtatggaaaaacaaaaaagatgcaataagacttgtcttatttgcaattttgggacttaccaattgtcaatatatgtatttgactgcaattgcttattcgaatgcgggaacggctactgtattgcagtatttaggtccggctttgattatgattatctcctgcgtgatgggaaggaggcttccctcgaaaaaagaactgggtgcaatcttgcttgcgattaccggaacatttctgcttgcaacacatggaaatccaggaacacttgtaatttcgaaagagggattattctggggactgagttccgcagtcgcactggtactttatacaatgctgccaggaaatttaattagtcgttatggaagtaccgtaattgttggttttggcatgatgataggtggtattttcttattttttgtatttggatattggaattataaaattgcttttcatttaccacttgttttaggtgtaggagcaattgttttgattgggaccgcacttgcatttacactgtatttacaaggtgtgagcgatatcggctcggtaaaggcaagtatgattgcatgtgtagagccagtatcagccaccattatttccgcattatggttaaagacaaaatttacaggaattgatatcgtggggcttatagcaattttaacagctgtattattattaagcaaaaaagataatagcagagtaaagactttgtcagttgaataagaaaataaaaaaattttgtttataggttatcggccggaacaaatctgatatactgtattttagaatacacgcacacgattagtttgaacttaccgacttgtttttgaaaatgatacaaaaaatcagacaaaaaacagaaaaaaatcagcaaaatacacaaaaaactcttgctctataaaaaataatacggtataatgaatataaataggggaataaaaaaatgtaatatcgtgaagatatataacctaataaaggaggaaacggaatgttagaccaatcatactatgaaaaggcggatgcgattattgaacagtatggtcgtaagcctgcctcactgattccgattatgcaggatattcaggcagaataccgttatttgccaggagagctgttaaattatgtggcagatgaaatcggagtcacccgttcaagagcgtacagcgtagcgactttttatgaaaacttttcttttgatgcaaaaggaaaatatatcattaaggtgtgtgatggtacagcctgtcatgttagaaaatctcagccggtaaaagatgcaattgtaaaagaactgggattagaggggaaaaaatgtacaacagatgacatgatgtttaccgtagagactgtatcttgtcttggcgcatgcggattagcaccaactatgatggtaaatgaagatgtccatccaaagatgacaccggataaggctgtaaaattaatcagagaattaagaggggggaatcaggaatgagtattgcaagcaaagaagacctgttgaacaagcaaaaagaagctcaggaaaagattgattcttacacctgtcgtattcttgtctgttcaggaaccggatgtgtggcttccggctcacagaaaatttatgatgaaatggtgaagctctgtgaaggattagataatgtagaagtcagcatgcagaaagacgtaccgcatattggtacagtaaaaacaggctgtcagggactttgcgaattaggaccgttagttcgtattgaaccacagcatttacagtatgtgcatgtccaggtggatgattgtaaagagattgtagaaaaaactgttttaaaaggcgagtcgattgaacggctgttttataaacatgaggaaaaaccatgtgaacatccggaagatattccgtttttgaatcagcagaccagaattgtactagagcattgtggaaatattgatgcggaatctattgatgaatacattgccgctggtggttttcaggcggttgtaaaggcattttttgagatgacaccggaagaagtcattgatgaaattacaaaatccggaatccgtggtcgaggcggtgccggtttcccaatgggtaaaaaatggagtcaggtggcacgaattgaatccgatgtaaaatatgttgtttgtaatggtgatgaaggtgaccctggagcatttatggatggctccgttatggaaggtgacccttataaattaatggaaggcatgattattgctgcttatgcggttggcgctcatgatggttatatttatgtgcgtgcggaatatccgctttctgttgcaaggttaaaactggcaatcgctcaggcagaagaatatggtcttttaggagataacatcttaggttcaggtgtgaacttccatttacatatcaaccgtggagcaggagcatttgtttgtggtgaaggttctgccctgacagcatcaattgagggtaaacgaggaatgcctcgtgtaaaaccacctcgtaccgtagaaaaaggtctttgggaaaaaccaaccgttttaaataatgttgaaacttatgcaaatgtagctagaatcattttagatggttcagactggtatcgttcaattggaacagaaggcagttcaggaacaaagacattttctttaaccggagcaattgaaaatacaggtctgattgaagttccgatgggaacaactcttcgtcagattatttatgatattggtggcggtattaaaaaaggagctgcatttaaggctgttcaaattggtggaccatctggtggatgtctggtagaaaaacatttggatgaaccgcttgattttgactctgttaagaagtttaatgcgattatcggttctggtggtctggttgttatggatgaaaatacctgcatggtagatgtggcaaaattctttatgggatttacacagagagaatcctgtggaaaatgcggtccatgtcgaatcggaacaaaacgtatgcttgaactgcttgagaaaattacaggtggtaaaggtgaaatgaaagacctggacaaactggaggaaacggcgaaatttattcagtctcgttccctttgtggacttggtaagagtgcaccgcttccggttatcagtacactgcaaaatttccgtgacgaatatgaagagcatatcgtagaaggaaaatgccgtgctcatgtttgtgaggtaatgaaagtttatacgattgaccctgaaaaatgtaagggatgtacaaaatgtgcacgtaattgtccggttagcgcaattacgggagaaaagaaagaaccgcatatcattgatcagattaaatgtattaaatgtggtacttgtatggaaaactgtgtatttgatgcaatcagtgtaagctaaaaaatcagtgtattgaaaaaaagaaaaggaggaggatgacatgattcatttgatgattgatggaaatcctgttgaagtggagaaaggcacaaccatccttcatgcagcgaaaaaggtaggaatcaagattcctacattatgttacatagaaaatttactgccggacggttcctgccgtttatgtgtagtggaagtaaaaaataacggaagaacaaaaattgatacggcttgtactttacaggcatcagagggcgatgaagtctttacgatgtctgaaaaagtaatccagtcaagaaaacagaccttagatttacttttatcagaccataacattcactgcttctcctgtgagggaaacggagattgtaagcttcaggattatgcttatgagtatggtttggattgttccagttatgaaggtgaaaaaagcggtggagaaatcgacgattccaataagttttttacttatgacccgagcctttgtattttatgtcacagatgtgtcaacacctgtaatgaaatcgtaggaagaggcgcaattgccacaatggaaagaggattccagtctattattggaaatggagaaggcaaatgggcagatggtacttgtgaatcctgtggtaactgtgttcaggcatgtccgacaggcgctcttaccatgaagcgcagaaagaaataccgtgcttatcaagtagaaaagaaagtgttgacgacttgtccacattgtgcaactggatgccagtattatctgttagtaaaagatggaaaaattgtggatacagaggcgtatgatggaccatctaataaaggtctgctctgcgtaaaagggcgaagcggaagctttgattttgtacaccatccatcaagaattactgacccattaattaaaaataaagaaaccggtgaatttgaaaaagcaacatgggatgaagcgcttgatctggttgcatccaaatttatggaaatcaaaaagaaatatggaacagaatctttagctggttttgcatgttcccgttcaccgaatgaagatatttacatggtacagaaaatggttcgtacctgttttggaaacaataataccgataactgtgcccgtgtatgtcactctgcttctgtagcaggtctggctatgacacttggttcaggtgcaatgaccaacccgattgaagatatcacaaagaaaccggatgtgattatgctggttggttcgaatccggaagaagcacatcctgttgttgggatgcagattcgtcaggcagttcagcgtggatgtaaattgattgtagtagacccgcgtgatatcggtcttgcaaaacatgcagatattcatctgaaattaaaacctggtacaaatgttgcatttgcaaatggtattatgaatgtcattatttctgagggacttcaggacgataaatttatcgctgagcgaaccgaaggctatgaaaaaatcaaagaaatcgtaaaagattatacaccggaacgagttgctcagatttgtcatattgatgcagaagatttaagaaaagcagcaattatgtatgcaaaagcaaagatggcaccaattatttattgtcttggtgtaaccgaacattcaaccggtacagaaggcgttatgtcgatgtcaaatatggctcttttagttggtaaattaggtcgtgaaggttgtggagtgaatccgcttcgtggtcagaataacgtacagggagcctgtgatatgggtgcttcgccgactgacttcccaggatatcagaaagtggcaaatccggatgttgttgcaaaatttgaaaaggcatggaataccaagttgaatccaaatccgggacttcatgcaacagatgtattcccggcagcaatcagaggagaaattaagggactgtatatttatggagaagaccctgttgtaacagacccggatacgcatcatattattaaagcactggaaagtctggacttctttgttattcaggaattatttatgacagagactgcggcttatgcagatgttattcttcctggtgtcagctatgcggaaaaagaaggaacatttaccaacacagaacgtcgtgtacagcgtgtgcgtaaagcagtaacaattcctggcaatgcaagattagataccgatattatcattgatttgatgaatcgtatgggttatcctcagccgcatctgacctcagcacagattatggatgaagtagcatctgtgacaccatcctttggaggaatcagtcatgcacgtcttgacagtgaagaagttgggggaaaagggcttcagtggccatgtctgacaaaagaccatccgggtactccgattatgcatgttggtaaatttgcaagaggtcttggctggttctatccggcagaatatattccgtcagcagaacttccggatgaagaatatccgattattctgatgactggacgtattttatatcactatacaacaagagcgatgaccggaaaaactccggaactgatggagattgaaggaaaatcctttattgaaatgaatgtggaagatgcagaagcacttggcattaagaatggagataaagttcgtctgacttccagacgtggtcagattgaatctacggctcgtgttggtacaaaagtatcaaaaggagagtcctggatgccattccacttcccggatggaaatgcaaactggctgacaaatgcggcgcttgataagtatgcaagaattccggaatataaagtatgtgcaattcgcattgaaaaagcgtagtacagcaaacttaagtttctgctgtagcagtagtagaactggttataaaatataaaaaaatgggggatattctcataagcggtaaagagaatatctcccgtttttgcatcaaatgattatttttatacaaaaacgtggtcaaggttgagctttttttgttactatgctacaataatttcaaaatcaaaataagagaaattttgaaaataaaaagataagaggaaaagatgatgaaatgtattaagacaacagaggcagtaggtcatgtactctgccatgatattacgcggattgtaaaagatgtggtaaaagatactgcattcagaaaaggacatattgtagaagagaaggatattccggtacttttatcgcttggaaaagataatttatatgtatgggaaaaagatgagaatactctgcatgaaaatgaagcagctcagattctctgtgacgtatgtatcaatgacaatatgcatccatccgatgtaaaagagggtaaaattgaattaattgcagactgtgatggagtatttcaggtagatgtaaagagactggatgctatcaatgagattgatgaaattatgattgcaaccaggcatacaaactttccggtaaaaaaaggagaccgtctgctgggaacaagagttattccgcttgtgattgcaaaagagaaaatggaacaggtgaaaaaaacagcaggggagactccgctggtttctttaactccatacaagaaaaagaccgttggaattgtgacaacaggaaatgaggtctactatggaagaattaaagatacatttacaccggttatcattgaaaaaatgaaagagtacaaaattgaagtatgtggtcatatcgtatgtaatgatgatatggaaaaaatcacaaaagcaattttagaattaaaggaaaaaggggcagagatgattgtctgtaccggaggaatgagtgtagatcctgatgataaaactccaggagcaatcaaggcaacaggagcaaggattgtttcttatggagcaccggtgcttccaggtgcaatgtttttactatcttacttaaaagatggaacaccggttatgggacttccggggtgtgtaatgtatgcaaaggcaacggtatttgatttggttttaccaagaattgtagcaggaattgaagtgacaaaaaaagatttggcacacatgggaaatggcggattttgcttaggatgtaaagaatgtcattatccaaactgcagttttggaaaaggtgtttaaaataatcaagtataaaaagatttcgagagcacattaagaaaaaagggggaaatgacatggaaaatctgacggtagaagaggcgcttgaacagttattatgtcatacaaaagaaatagaagaaacggaagaggtgtcgttgcttttggcaagaggaagaattcttgccaaagatgaaaaagcagagtttgataatccgccatttgaccgttctccggtagacggatatgcctgtcattttgaagatttaagtgaagcaaaaagtgatacaccagtgtgtttaaaagtaatagaggaaatagatgcaggtcaatattctgatcgggaagtaaaattgggagaggctgttcgtattatgacaggagcagccattccgacaggatgtgactgttgtgtaagacaggaagacactgattatggagaagatacggtaaagatttttaaaagtaaaaagaaatggcaagactattgctttcaaggagaggattttaagaaagataccgtattattaaaaaaaggtacaaaaatcggttttgttgaaactggaatccttgcgagtatgggcagagcaaaagttttagtaaaaagaaaagtaaaagctgctgttttaacgaccggagatgaagttatgactccggggcaacctttgcttccgggaaagatttataactcaaaccagagcctgctggtgactcgtctgttggattttgatgtagaactggtacgtattgatacgattcaggatgaaccacagaaaatggcagaggcaatcaaagaaatcgcaggacaggtagatttaatcgtaacaacaggagctgtatcggtaggcaagaaagatattatgcatgaggcacttcgtctgattggggcagagcgaattttctggagggtattaatgaaaccgggaatgccaactttgttttcagtatatcatgatgttccgattgtcagtctttctggaaatccatttggtgtggcggtcagcgtagatgtactgattcgaccaatgttacataaaatgacacaggatgaaacacttgcgattgtacataaaaaatgtgtattaaaaaatgaattcagtaagaaaatcaaagggagacgatatgtacgtgcttttgtagacgaaaccggagttatgattccatgtggacttcattccaatggagttcttgcgacaatggcaggatgtaactgtctgattgatatgcaggagggaaggccagggattcatgcaggagaagaggcagaagtgcttttgttgtagattcgatttgatttaaaatttgatttttggattttgacattaaaataagattacagaaaaaccggataaaagaaaaatgaaagcagaaagaacacagaaaaaacagtttatactggcagtaagcggagtaaaaaactcagggaagactacgttaattacaaaaatattgccctttttaaaggcgaaaggcttgaatgtggcagttattaaacatgatggacatgattttgaagcagatgttccggaaacagacagctggaagtttgcaaaggcaggtgcagatagcactcttatattttcaaagacgaaatatatgatgattcattatgacacggtactatcagaagaagaattcattgccagttttccgagcgcagatattattttgctggagggatttaaatattcaaagtactcaaaaatcgaactcatacgaaaaggcaactcggcaaaatctgtgtgtgacagtaaaaagctgttaggaattgtgacagattttaaaaaagaggaattaaaagaacaaaaaatattagaaacagagaaatgggagaaacagataaagatttttgatttaaatcaagcagggtctttggcagaatggatttatcaattatgggaagaaatccagaaaagataatctgaaaaaagtgaaaaggagcagtaaatcaaatggaagagcacaacagtatgacagaaaataaaagagagacaaaacttggggtaaaaacgaagcttgtcatcacaaaaacagaagatttttttggaccgggactgtttcatcttcttcagtttattgatgaaactggttcgattcatgcggcatcaaaaaagatgaaaatttcttattcaaaatgctggaaattgttaaatcgtgcggaagagcagatgggatttcagtttttaaatcgttacaatggtggtccacatggaggaacttcgatccttacagaagagggtagagaatttataaaacgatatgaggaaatgttggaagaagtaaaacagataagtcagaatgtatttgaaaaatattttgacagttatcagtaaaaatgacagggtgtcttttctttatttgaacgcagataaacattcccccactgacagatcgcaaagcgactgcgttcatgagcaagtagcgaagcggattgcgaatgtccgctttacagcaccctgtctatttaatcgaattaagaaagaccttcgattcaaaaatttttgtttgacaaagacttaagaaaatactttcatgcggtctcgccgtgcagcacaaattaaagttaaatgatattctttcgcaagttcaatcgcttctacagtaggagaagctttactggcaagaattggaatttgtgcataaatcgctttcattgccatgtcggttgggattcggccgcttgaataaacgatgcattcgcgtaaatcaatctgatttctaagtgcataaccgatcactttatcaagcgcattatgccggccgatatcttcacaggaaaataaaatctgaccgtttcttgcaagcaaacagctgtgagtggcgaaagttgtgctgtgaagcggcatgccgtcagcaaaggcatctgccatctgaaaaatccagtcgggtttccagttaatagaaggtacagtctttggagtttgtccggaaacaaaataatcatttaaaatatggtttccggtgcagcaggtaggagtgatttctataaaaaaattgttttcggtattttgcggaagtgttttcgatgttctgtttaaataaacctttgcccgttttccatattcgcagatataaatctgttcgatatcggagatggaatcaataattcgttccgttaaaagccgaccaagaactaattctgtcagatactgcgggagacaaacgagtttcatcgttaaatggtcatttaaatagacgtcaatcagatgctcttttaaaatttgttcctgttttgaaataagttgtccatcacggctgataaaccggtattcttttgtttctaataatggtaaatcgtggtattgttcgttaatatacataatttctccaatgcaaaaaagagttcttttattcatgttttctatgtgttatgataatagtataacagaaatgtctttgcttcaaaagagggaaaatataaaaaaagcagagaacaaaggaggatttattttagatgggaaaaataatagctgtcaatatcagtgagaagaaagggacacaaaaaaagaatgtgcatcgtgcaaaattaattgaagaatttggaattgaaaatgatgcacatgcgggaaaatggcatcgtcaggtcagccttctttcttacgaaaaaatagaggaatttaaagcaaaaggtgcgccgattgatgatggtgcatttggagagaacttaatcgtaagcggatatgatttaaaaagtcttccggttggaacaagatttcgctgtggagaggtgttgctggaagttactcagatcggaaaacaatgtcacagtggctgtgaaattttcaaaattatgggagattgtattatgccaagagaaggtatttttacaagagtgcttcatggaggaatcattgaagagggggatgagattcatatagaagaagaaacggatggagaaacagaaaagtaaattatgaaagataaatatggacgagaaattgattacttgagaatttcaattacagaccgatgtaatttgagatgtgtttattgtatgccggaagatggaatctgtcaggtttctcacaaagaaattttaacttatgatgagattcaaagaatctgttcctgtattacaacgcttggaataaaaaaataaaactgaccggcggagaaccgctcacaagaaaaaattgttcgaccctggtaagaatgttaaaagaacttccggagatcgaaaaagtaaccttgacaacgaatggaatgttattgaaagaacagatacaagaattggcagaggctgggattgataacattaatatcagtctggacactgtggataaagcaaagtttgagaaaattaccagaagaaaaggactttttaaagtgttggaaggattggaagaagctttaaaatatcccaatataggtctgaaaattaattgtgttccggtagttgaagaacctgaaaatctggtggcagttgccaagcttgcaaaagaatatccgatacatgtccggtttatagaaatgatgccgattggttatggaaaagaatttttatttcgaggagaaagtgaaatctgtgaaattttagaaaaagcttatggcagaatgactccaatttcaatgaggtatggaaatggaccctgccattactatgaaatttccggatttttaggaaaaattggatttatcagtgcaatgacccataaattctgtgaccagtgcaatcgtgtcagaatgacagcagagggatatttaaaagcctgtctgcagtaccagacaggaatcagtttaaaagatttaatccgaaatggatgtacggatgaagaattaacacaagcaatgaaaaaagtgatatgggaaaagccggttgggcatcattttacctcagggaacattgaagaagacgagatgaaactgatgtcacagataggtggctgaaggcgaaataaaaaggcgtgtttgtcggagaggagtaaaaatgagagcagcaattattacatccagtgattctggatatgcaaaagaaagagaagataaaagcggtccggtgattcgtgaaattttggaggcaaatggatatgaagttgttcatgccattttacttccggatgaaagagaaatgcttgcaaaagagatgaaaaaaattgcagacgaagcgattgcagaattgattgtaacgacaggtggaaccggattttcaaaaagagactgtatgccagaagcaacaaaagatattatagaaagggaagtaccgggaattccggaagcaatgcgtgcttacagtatgacaattacgccaagagccatgttaagccgtgccgcagcaggaatccgaaaaggtactttgattgtcaatcttccgggaagtccaaaagcggtaagagaaagtctggaatatattattccggctctggaacatggattacagattttaaccggggaggcttcaaactgtgccagaaaataaaaccgctttggtgattttagccggtggaaaaagcagtcgcatgggacgtgaaaaaagtgatttgattttgaatggaaatacttttttggagatacagatagaaaaaggaaaacagcttggaatcaaaaaaatttatatttccggttataagggagtgcgctgtacggaagaaattgtaatggatcgtatcaaaaaccgaggaccgctcggaggattggaagcctgctttagaaaagcatcagaagagggcttttcgcattgtctggtattaggtgtagatactccgcttgttccaaaagaagaattaaaaagtttagttgacaaggcacaaaaagaaagtgaaaacagagtggttctgcttcgacatgccgaaaaagaggaatctttgatgtcagtgtatgaaagtagtttatatcaggaaatagcacaatttctggaaacggggcaggcatctgtttttcgctttttaaatcaggttggttatgactgttatgatacacaggcagaagaatggtattttaccaatattaatgaaccggatgtgtatcaggaaatctgtaaaaaagagcagaaaatctgaattcggttagaagaaaggatttaactgaatcagataagtcgagatagtggttatttcttgtatgctgtactggaaatggtgaaatagaaaggatgataagatgattgatttacatttacacttagatggctctttgaatccgaaaaacatgttttggatggcagaaatgtcaggtgtgaaactatcgtttacagaagaaaacgaattaaaaaaacagatgatggtagagccggattgtaaaaatctcggagattatttagaaaaatttgatttaccgcttcaggtattacagacaaaagaatgtctggagtatgcagtctatgaattactaaaagaattacaagcgcagggactttgttatgcagaaatccgctttgcgccacaacttcaccaacaaagaaacttaacacaaaaagaagtggtagagtcggcagtcaaaggactcgaaaaagcaatgaaagaatttccgatagaagcacagctgattttatgttgtatgcgtggagagacgaatcatgctgagaatttagaaacagttaaaaccgcaaaagaatttttagaaaagggtgtctgtgcagttgatttggcaggaaatgagtcggcttatccgacaaaaatgtttgaagatgtatttttactggcaaaagaacaaaatgtgccgattattattcatgcaggagaggctgccggtgcagaaagtgtagaagaagcattagcgtgtggggctgtcagaattggtcatggaattcattcaatagaaagtccaaagcttttaaagcgattaaaagcagaaaaaatatatctggaattatgttattccagcaatcttcagacacaagctgtaaaaaattcctgtgagtatccgcttatagaatttttaaaaaaaggaattttagtgacgattaatactgataatatgacggtttcgaatacttcgttaaaaagagaatatcggttgttaaaagagacatttcagctttcggaggaaatgctacttcagcttgcagaaaacagcgtagaagcggcatttctgccacaaaaaaagaaactaaaattagagcagaaagtaaaacaggaatttttgaaatggctgagtacagagagaatttaatgaggtaggtgcgattaaaggaaaactgctggatgccgatgcccagtgggtaaaagtggaaacatcgaaaaaaggaacacagctgattaaccggaatatgattcgtaatattacttttgataagtagaatgaaaaatataaatcaggagtaaaaatttcaacgagcaggaaacagtaatgtcaatgttgcgtggattttggaaggagaagaacagttcgaatatatgtatcggctgttctttttttatttttaagcgttaattaaataggagaggtttttcttgtgtatagtagggcattagagtataataaaaccagattgtctgcatacgtttaaaagctaattcatttataaatacaaagaaagttcagaatggggattcgtaatgaaaaagaaaaaatggaataaaatactggctgtgcttttggcaatggtgacggcagtatcacttttgtcaggatgtggcggaaagagtgcggaaaaagaagataaagaaacaataacggtgtatttatggagcacaaacctgtatggaaaatatgcaccatacatccaggagcagcttccggatatcaatgttgaatttgtagtagggaataatgatctggatttctacaagttccttaaggaaaacggtggattgccggatattataacctgctgtcgcttttcactgcatgatgcaagtcctctgaaagatagtctgatggatctttccacaaccaatgtggcaggtgctgtctatgatacatacctcaggaattttatgaatgaggatggaagcgtaaactggcttccggtgtgtgcggatgcacatggttttgtagtcaacaaggatctttttgaaaagtatgatattcctctgccaactgattatgaaagctttgtttctgcctgtcaggtatttgaagagatgggaatccgtggttttgccgcagactattattatgattacacctgtatggaaacactgcagggtttgtcagcgtcagagttatcttctgcagacggacgcagatggcgtaccacctacggcgatccggatagtacaaagcgagaaggtctggacagtaccgtctggccggaggcttttgaacgtatggagcagtttattcaggataccgggttaagtcaggatgacctggacatgaattatgatgatatagttgagatgtaccaaagtggcaagcttgccatgtactttggcagttcttccggagtaaaaatgtttcaggatcagggcattaacacaacctttcttccgttctttcaggaaaacggtgaaaagtggctgatgacaaccccatatttccaggtggctttaaactgtgacctgacaaaggatgaaacacgccgaaagaaagcaatggaagtattgagcacaatgctttctgaggatgcacagaaccggatcattagtgagggacaggatctgttaagctacagtcaggatgtagatatgcagcttacggaatatctgaaagatgtgaaatctgtgatcgaagaaaatcatatgtatatccgcattgcgtcaaatgactttttttcgatttccaaggatgtagtttctaagatgctctcaggagaatatgatgcagagcaggcctatcagtcatttaattctcagcttcttgaggaaaaagccatttctgaaaatgtagtattgaattcacagaaatcttattccaaccgctttcatagcagtggaggcaatgcagcctattcggttatggcaaacacgctgcgtggcatttatgggacggatgtgctaatcgcaactggaaacagctttacgggaagcgtgctgaaagctggctatacagaaaaaatggcaggtgatatgatcatgccaaatggtctgttggcttacaatagtaagatgagtggagctgagctgaaagagacagttagaaattttgtagaaggctaccaggggggatttattccgtttaatcgtggttcccttcctgtggtcagcggcatttcagtggaagtcaaagaaacagctgatggttatacattgagtaaaattataaaggatggaaaaaaaattcaggacaatgatactttcacggtaacctgtctggcaataccacaacacatggaagcttatccggcagatggtaatattacatttaatggaggagatacctctgtgaaagatacttggacagaatatgtttcagagggtaatgccattcttgcagagtctgaagactatatgactctgaagtgagaaaattgaaaaagaaaagtagagggtatccattgctttaaacgcacaacacacaagccatctcatggtggctctcataagaaggggctcccttcagaatcgtgaagttcagagagttataaagaaaaatcaggctcaggaaaacatttttataacattttgtgcctaagcgaaaggaatggatataaaaaggaatggatataaaaatgaaagttaagaatcgtaatacaaaaagagagaaacgtgttataaaaaaacggttaaagatagctgtctttattgttctctttataggaatcatctcggctgttttccaatatttcaagtttgtgtccgcaactgtttatgaggaaagtgtttctcatctgacggaggtctttcatcagtctgataatatgttgagggaactgataaataaaaatctgacctatctccatatgtggggtgagaatcttcagaatacctccagtgaagatgaaatttgtgattatatagagaaagcacaggaagatgcaggttttttagaattctattttctatcaacaggtgggaattacaagatggtaacaggggaaacagggtatcttggattacaggaagatattgaagaagacatccggcagggaaatgatgtgataacaaatgcagcagtcccaggaaaatctcagctgcttgtttttgccactcccaaggctcatggaaactatcagggatttgaatatgatgcgattgccattgcttatgaaaactctgatatcgtagatgtgctggatatttctgctttcaatggaaatgcccagagttatattgttcatccggatggtcgtgttgtggtcgatcattcttctgagtcatgggggaacgtgtataatttctttggtattttgagagaacattcagatatgtccgaaaaagaaatcaatgaactttcggagaagtttaaagcaggatgtaccgatgcgatgatggtaaatctggatggaagaaactattatctggtctatgaaaaatcggatattcaggactggatatttctgggacttgtccaggcggatatcgtcaatgccagtatgaacagtctgcagcgtagtacgatacttcttgttagtacggttgtattctgtattgctgcatttcttatcagtctgattattcaaaaaggtagaataaatctcaggaaaaaagatacagagatcttgtacagggatgagctgttccaaaagctttcaatgaatgtggatgatgttttcctgatgctggatgcaaaaacatatcaggtagattatgtcagcccgaatgcggaaaaactgtttggtattacagtagaacagatctgcaaagacatttatgttctgaaaagactgcgtctggagaaatctgaagattcggagaaaaattatttggaagaaatccagattcatgaacagaaggaatgggagtttgaatgtgttcatcagaagacaggtgaaaaacgctggttccataatattgcaatgggaagtgagataaacggagaaaagaaatatatcctggtcatgtcggatcgtacctctgactggaaaatgaatcaggcactttctgaggcagtgcgtgcggcggagacggcaaacagggcaaagagtactttcctttccaatatgtctcatgatatccggacaccaatgaatgcgattatcggctttactacactggctgtaagtaatattgacgataaaaaaagagttcgggattatctgggtaagattctttcttccagtaatcatctgctctcactgatcaatgatatactggatatgagccgtattgagagtggaaagatccatctggaagagacagaggtcagtctgtcggatgtgcttcatgatctgaagacaattattagcggacagattcatgcaaagcagctggagctttatatggatgcaatggatgttacaaatgaggatgtctattgtgataagacgcgactcaaccaggtgttgctgaatcttttatccaatgcggttaagtttacaccggcaggcggaacggtttctgtccggctcaaacagtacccagggacagtaaaaggcagggaattgtacgagatccgggtaaaagataacggaatcggcatgagttcggaatttgtacagaagattttttccccttttgagagggagaggacttccacagtcagcagaacccagggtacagggcttggcatggctattaccaaaaatattgtggatatgatgggtggaacaattgaggtcaggacagagcagggcaaaggtacggaatttattgttcgtctgccatttcggattcagtctgagcacaaatacatagagaagatcgctgagttggagggtcttaaggcactggttgtagatgatgattttaatacctgtgacagtgtgacaaaaatgcttgtgagggttggaatgcgttcggaatggacactttctggtaaggaggctattctccgtgcacggcagtctatggaacttggggatgcattccatgcttatatcatcgactggcgtctgccagatatgaatggcattgaagttacacgccagatccgtagtcttggtgatgatacaccgattattattctgacggcttatgactggaccgatatcgaagaagaggccagagcggctggggtaactgctttctgcgcgaaaccaatgttcatgtcagatatcagagataccttgatgactgctatcggtcagaagcaggttgagcaggaggatactatttttcctgaagcaagttcggatttcagaggcagatgtatactgcttgtggaggataatgaattaaacagcgaaattgcggtggagatccttaatgagtatggttttctggttgaaactgccgaaaatggagctgaggcagtggagaaagttaagaattcgacgccaggtaattatgatctggtgttgatggatgtgcagatgcctgtaatgaatggatatgaggccactaagcaaatccgtgctctggatgatccgacactggcggaaattaccatccttgctatgaccgcaaatgcttttgatgaagataaaaagaaggcaatggaatgtggtatggatggcttcttatccaaaccaattgttatagaagagttgctccgtacattacagaagaatctgaatcaggtgcccggagtatcagaaaaatcacgcaaataaagaagtaagtgtaaatcagatgattggtattatgattggaagtatagctgtatttggaattatttattattttgttacattgttgccagaaggtgaaggcggacgataagcaacattatttttagaagatgaaaagccaaaacagaatttctgaataatatgtcccatgatatccgtacgccaatgaatgtgatactgggatataattagctgatgaaagcacaactgacagaaccgaagcagcttgattatcagaagagaatcgaataatccgggaaactgttataaattagggaggtgctacaatgccatttaagatagtccgcaacgatataacaaaagtaaaagcagatgtgattgtaaatactgctaatccaaatccgatatgtgcaagtggcacggacttagcaatatatgaagcagcaggaaaagaaaaacttctcgtagaaagagcaggtatcggcaaaattgcaaggggtgatattgctgttaccggtgcatataacttaaaggcaaaatatattattcatacagtaggaccggtatggacagatggaaagcatcatgaatttgaaatccttgagaattgttatcgaaaatcattacagaaagcattggaacttgagtgtgagagtatagcatttccactgatttcgacaggagcatatggatttccgaaggataaggcattacagattgctgtgtcagtattcagccagtgtcttaccgaaaatgagatagaaatcatacaggtagtatttgataaaagatcttttcaactttctggtcagattgttgggaatattgattcttatatagatgcaaattacgtcagagaaatccatagaaaagagtatccgataaggagcagaagaagtactcgtataaaagaattggcagaagaagattttaatgaggaaatgcttcaaagagaagaagacaactatccacttgagaaaatgacagatacgggcatgacagagttgctcatgccgttagaaagtatatcattagaagaccagctggcaaatataggagcttcctttcatgataaattatttgagctgatcgacgaagcacatcttgataataaggatgtgtggaaacgggcaaatcttaatagaaaacatttttcaaagattcagtgtgaccagaactatcatccaaagaaaaagacggtaatggcactctgtattgcacttcagcttgatctggaacagtcaaaagacttacttgccagagcagactgggcattcagcccaaacagtaaggtggatttgattgtacaaaaggcaataatagataagcagtatgatattatgcagctgaatatgactttgtttaagtatacgaatgaaattcttggagtataggagcaagatggatatgtggaatgagtggaatgacatattttctattcaagaaaaagccagctacaaagacatatgataaagaaaataagaaaccagtaatcaaagcgagcatatgtaatggcgagcaggtagctgggtttaaagatatttatacaggtaaaatagaggagattatgctgattaagaaccaggcagaccttgatgcattcaagaaaatgtatggaatagatggcgagatagaaaaggaatattaaacaatgtatttgattaaaatatcctcattgtaagacaagaacttggtgcaagaaagtcatgaccaaagagtgataatcaaatcatatagacagggtatgtcaacagcaggttgcttttcagaacatgaatttatctgtatgatatggttatggaggtgacgacgatggaaacaaaaaatattattttgaaacttcgtactgaaagaggaatgtcacaagacgaactggcagataaaatcatggtcacaaggcaggcagtatcacgttgggaaaatggagatacagttccaaatactgataccctcaagctcttatcgaaagaatttgatgtttcaatcaatacgcttttgggagaacccagaaagctgatttgccagtgttgcgggatgccaattgatgaggattccatattgggacgtgataaggatggcacattaaatgaggagtattgtaaatggtgctatgcagatggaacgtacacatataacgatatggatgaattgattgatgtatgtgtaaagaatatggtaaatgaaagctttaccgaagaacaggcacgcacttatctgaaagaaatgcttccaaagttagattactggaaaagatatgatgagcttagtgacaatgggcagtttgaagagtttaaaaagcaattgataaatgaaattaatgatctgcatatagacggacttccaagggtagacaaactaaatgcacttgtggggaaatatgtgaatctggattatactctgcctaatggtcaaaaagtgaaattccttgatgatcagaaaacctatctggggaaccaactggagtctgaatttggaggagacaggtgcttcggtattctggcaggtatggattttattctggtatgtacatatgagaaggatggtgaaaatccagagttgttgatttataaaaagagataatataagcaaaaagaaaagtcttgagtagtgtattatgaataaatacttaaactactggggagtgatttttgcggctatctttgctccgtgtcatatcctaataagctatatgaatgcggttttatcatgatttgaagatcgataacttatggcagatatgaaggtaaaaatagatgaagtgttcaaacaaaaggagaaaatatggaatcagatataattaaaatcagccatctgaataaaagctttggcgaagtaaaggcagtaaatgatctgagctttcgtgtgaaaaaaggagaattgtttgcgtttcttggagtaaacggtgcagggaaaagtacaaccatttctattctctgtggattgctgaaaaaagacagtggaactgttcagataaacggaatagaaactgacaaagccggtgcacagacaaaaaggatgattggtgttgtatttcaggatagcgtacttgataaaccgcttacggtgaaagaaaacctaaagagcagagctgctttatacggcattacaggaaatgcctttgataagagattacaggagctggtcgagattctggattttgacgagtttttaaacagacctgtaggtaagctgtcaggaggtcagagaagaagaattgatattgcccgtgcattattgcacagaccggagattttgattcttgacgagcctactacagggcttgatccgcagacaaggcagttaatctggaatgttatcgagaagcttcagaaaacagaaaatatgacagtatttctgactacacattatatggaagaggctgctaatgccgggtatgttgtaattcttgacaaaggaagtattgcagcggaaggtacaccgtttgaacttaaaaatgattatgtacaggatatcgtatctgtttatggtgtttccgaagatgaaataaagtcattgaacagagaatataaaaaaatacgtgatggatatcagataaaagtaagaaatacgaaggaagcaatgaagcttattgtagagcatcaggacctattcacggattatgaagtagtaaaaggcggtatggatgatgtatttcttgcagtcacaggaaaaaggcttggaggtgagcattgatgagaacagtattggcattaatgaacaggaacaggaaactgttttttaaagataaaggtatgctgtttacgtcaatgatcacacccgtcattctgattgttctgtacgctacgtttcttgcaaaggttttcagagattcttttacagcggcgattccggatatgatcacgatttcggataagctcatcaatggaaccgtggcggcacagctgacagcatcacttatggcagtaagctgtattactgtaacattttgtgtaaatctgactatggtgcaggacaaggcaaatggaacaaggaaggattttaatgtttcaccggtcagcagggaaaaaatttatttgggatatttcctttcaacagttgctaattctttgatggtcaatggacttgcgtttgtattatgcctgggatatttatttaaaatgggatggtatatgaatgcagcagacgtaatatgggttttatttgatatgatattgctcgtcctgtttggaagtacgctttcaagtatcattagctttccattgacaacacagggacagctttcggctgtgggtacaattgtcagcgcaggttatggttttatatgtggagcttatatgccaatttcaaattttggttcaggtcttcagaaggcactgtcttatcttccgagcacatatgccacttcattgattaagaatcatatgcttcacggagtgttcagggagatggagagaaaacattatccggatgaaatggttgaagcgataagagacactcttgattgcaatccggtatttcatggaaatgtggtaagtgtaaatcagatgattggcattatgatgggaagtatagctgtatttggaattatttattattttgttacattgctgccagaaggtgaaggcagacgataggaaatattattttcagtgagtgaaattcctttgttttgtccaaaatgcaaagaagaaagcctgattaatgcagaaaaatttatagtaaaggaagccagacgctaagacgcagtgcagattgtaatattacagttttgcactgtgtcgtttatattatggaggtcaaataagaatgaaagcaatcatatatacatcaaataccggaagtacagcagagtatgcaaaattactgggaaagggattgaatcttccggtacataaagtacgtcgttatattctgaatagaatgaatacgacaaaaaagtgcaggaatataaagatatggaattaagattattacgttattttttaacagtagcaaaagaacagagctttacaaaagcagcagaacaattgcatattacccagccaacgctttccagacaaatggcggcatttgaagaggacctgggaataatattatttattcgaaacgggaagaaaatatcgctcactgatgaaggaattttattaaaaaggcgtgccttggagatccttaatcttgaggaaaggacgctggaggaactgaaaggaaaagaagaggttgtagagggcacgataaccattggatgcggtgaatttgcggcagtggagacattggcgaagatatgtaaaacgtataaagaaaaatatccgctggttcagattgtattgcatactgcaacagcagatgtagtgtatgagatgatgaacaaaggacttgtagatattgcattattcatggagccggtggacaccgaagggctggattatatccggatcacagattgcgatcactggtgtgtcggaatgcggccggatgatccgctggcagaaaaagagtttataaaaaaagaagatcttattggaaagcccttgatcctgccagaaagaatgaacgttcaaagtgaacttgccaactggtttgggaaagacttttcaaaattacagattgcttttacgagtaatcttggaacgaatgccggagttatggcggcaaatggactggggtatccaatttcaattgagggtgctgcaaagtattggcgagaggatattcttgtacagcgaagaatttctcctgaaatcacgaccagtacggtgattgcctggcgacggaatatcccatattctttggcagtccgtaaaatgattgaggagattaatgcttttcaggcataaaacaaaattcaatataagcattagacataatgaagcgatagagcttaaaatagatgtgtaagatgaatgtaaatcttatacatctatttttttgtgaaaaatacgtatagaaaggggctttttattatgagtaaaaaattagtggcatttttcagtgcaagcggaacaacaaaaaaagtagcagagatgatcgcagaggaagtaaaagcggatttgtttgagattgagccgaaagttccatatacaaagcctgatcttgactggatgaataaaaaatccagaagcagtgtggaaatgagtgataaaaaatatagaccggcgattatgaaaaaagagatggatatgagttcttatgacgagatccttctgggattccctaaaatggagtacagtttatagtagtgtatagcgtgtaccaagttataattatggggttgaaaataacagtatacacagataatgtggaaaaatgtgtatgacgtttatatagaaaataacattgaaaaagaaattcaagaatgggtaaattcattaaatttaaaatagaataataattacatgagtgacagaagataagaatctgaattccctgtcacttttatattatttgataagaaaaaagaactggtttatatccgataagaatatagactggttcttatttttaatatgctattatatacacagggagtcggggaatgtcgaactatagcaagccggaaaagaaagcattgatatcggtatgaaagagttttgcaagtgcaactaattcagatgccttaatgttcatgcgatttgtttccagtttggcataggtacttttagtgatggagatacccataagatttaattttgcaactacttggtcttgagtcatattgtttttataacgaattgcttggatatttttaccaatatccatatctggtctaatcttttgcataataatgaactccccttataaaataaaaagtttcgcaataaagaaatatatatattgattctaaagagtttaaaatttataatgtttcgtaataaggaattatttttaacaagaagaggtaaaagtatgatggatgtggagcaggaaaaaagaaaatttttaaatctatgtggcaaaagagatcgagcattattgtcaggtgaaaaaaggatgacattgggggatatggaacgattgacatatctgacagaattttttgaactggagaactacggaatcgccttatggaaagaatttggtgatgatgtaaaagagccatttgaagcgatgatgaaaatgttagatgagccggagtgcatagaagatcgatggcttgatgacgaagcaaaaggagaaaagtggttgttagaatttcaggaattagcattaacggaagaatacagggaatggattcgagattatatcgataaaaaatatgaagaaaaaggattaccatatccgacaggagcagacttcgattaaggggtctgtttttttctggtcttttgggaggtgataagaggtggaagtaagtatttatgaactgttggcggcagcgagagaatcggctaaatctgattatataaaaggggacagcattttatgtgcgaaaagattttatccagattcccattacatggtagaaatagagttattagaaaatgataacaagctgggagaaaaggggaattacatacggaagtttctgacagaaccggagtatcttcccattttacaaaagcaggaaaaacatctcataaaaataaaaagacaggcgattgttcaaaaaggaaacttgcgatatatccctcccctggacaggctggaccgccgccgggagagggatattttataaccggctgggaaggaacagtagtgttcctctggcgatagtggtataaaaaagccagattttccgcaggttttgggacgctggaacatggaaaagtgttcacgaatggcacttttgcaacaatccgttgcagcagtgaaagcatttttgaccttacgttaaacagaaaaatgaaagggtgtgattgtgataatcataggaattgatcatggctattatgcaataaaaacaagacaagtgtctttcccaagtggaattatcaggtatgattacgagccgtataccatgcagaatgttctgcagtatcagggaaagtattatgtctgtggtacagggagacagacactggtaaaaaataaaacgtccaatgataattattatctgctgacgttggcagccattgcagaagaaatcaagcatcggaaagcggaacgaaagacagaggtaattctggctgttggacttccgctttcaagttttggaagagagaaacagggattcagggagtatctgttgcggaaagagcagccagtgcgatttttatatgaaagtgaattatatgagataacaataaaagatgtgaaactgttcccacagggatactctgcgcttgctctgcatccagagtatctgaagaatgaaccgtctgttctgcttgttgatattggtggctggaccgttgaccttatgaggctggacaatgctgttccgaatgcagcaacgtgcaggagtctggagcttggagtgatccgatgtattgatgagacagcagaacaggtgcgtagaaataccggactgtctgtaacagaaactcaaattgagcgtgtgcttcggggagaatcttgcagtatggcagaagaggccagacggatcatacaggaaaacggacggaaatatatagaaagaatactgtctgcggtgacagaatccgggtttgatctccgggcagtaccaaccgtatttatgggtggaggctccacaattttaaaacgccacgtgaccgcacaggacgcgatttgccgccttgtttttatagaggacgtccatgccaacgcaacagggtatgaacggattgtagagcagatgtgggcgagatgacacgccctgtgtattcgttccgcccgaacctgaaaaatccagaacaccagagagcatgggagaaatttcaaagtgttccagaagggcagaaaagccagtatctggttcaggcaattctggaaaaagaggatcgaaaatggctggaagaagtcattcaaaagacgataaaagaaagtgttcaggaattaggaatatgtggcactacggaacaatcgacaacgaaactatcatcggaagaaataccagatcagatgatggattttctatctcaaatggaaaatttgtaaagggggtgaggcctatgattgcacgatacatacattgttggatctgctaggggcaaggcaagaaatgcatcgttatctttggtgggtattgtgaatagctttccatgcggctttggagtatgttgtgtgtagcgaaagagaaaggagaaaggttatggcagagatgaaaaatatctgcggaaagatcccgatggacttacatgagaaagtaagagaagagattgaactcacagaaagcagcacacaaaaatttttacaacaggtcattgaagaacatttcaacagactggaaggaaaaggagaaataagcatgggagcagtaagaacagtagcagtacaggtatcagaggaattattccagagattaaaagtagtcatcggaaagaaacacatgaaacagaaagacttcttaattcagattatagaagaagcactggaaaaggcagaggccgaatggcaaagcaaagatcagcctgaagaatccgaacagacaactggagaattgggaacagaagaaactcaaccggaagaaagcactgagccggaaagggaaagcgaaccagatggagagagcgaaccgaaagaggaaaacgaatcagaagaggagagcgaaccgaaagaggaaaacgaaccagaaggggaaagcgaaccggaagaggaaactgaaccagaaagtgaaactgatctggaagaagaaaccaaagcagaagaaccaacagaatggtaaccaattgatacagaataacgaagggcggtatgagagatcatgccgcctgtttttatcagcaaaaaggaggttgatagccgcaaccattcaattttttgatctctttagcggaatcgggggattccgtgaaggcttaagacgggcaggaaactttgtctgtgtcggacattgtgaggtggatacttatgcggataagaactaccgattgctgtttgatacggaaggggagtggtattgtaatgacgcaagaacaatcgaaccagaacgaatgccagattttgatttactctgtgcaggatttccttgccaggcattctctatcgccggaaagcgagaaggatttgccgatgcaagaggaactctcttttttgaaattgcccggattcttgaagctaaaagaccctcgtattttatccttgaaaatgttcccggtttgttatcgcatgacaaaggccggacgttttgcaccatcctcagtacgctttctgaactggggtaccatgtcgaatggaaagtgcttaacagcaaggatttcggagtcccccaagcaagaaaacgggtgtatattgtcggatatcttgatttccgatgtgccggaaaagtattacctgaaccagaaacaaatggagcagctcttgttcaaatccgggcaggaagtcagggaaaaagagtttacagtccaaaaggattaagctgtaccctgacatcacaggccggaggaatgggtggaaagacaggattatatgatgtgggtgttccaattaaagaaaatacaaagctcggctacaaacttgcaagagagggtgacagcatcgatttaggctatgcgaatctcaacagcaggagaggaagagttggacatcagatagcacacaccttgactacaggtattcaacagggaacacttcattttgtagatttgtctccgccgccactggtaactgaagaatgcagaagccttaatacccgacaatgcggaatccataaatacaaaggagaatgttccggtgtattaagggaagaaggggcaagagcagtccttacaccagccaaggaaaatgtccgtcagaatggcagacgtatgaaaaatccagaagaaccgatgttcacaattactgcaaccgatcgtcatggcatcttgtatcacggaagaataagaagattagttccaagggagtgtctgcgtctgcaggggtattatgattggcaaataaataaaatcatagacagcacttctgatgcacagctttataaacaggctggaaacggggtaactgtcaatgtcatcgaggcaattggcaaactattacaaaaggcagactccgaactcaacgaacaggaagtgtctgagaaaggaatccattaggcatgatcggtataaaagaccaatactttggcacagaaatcgaaatgacagggattaccagacaacgtgctgcagaagttgttgctgaaatgtttggaacagaagcatattatgacggcacgacctacggaatctggtcagtgatagatttggaaggaaaaaagtggaaatttatgtctgatggaagcatttatacacaacggaaagtatacggtcgaattgtagacgcaggcggagaatattcaacagaaatggtatctccgaaattatcctatgatgaaatgggtaagttacaggaagtagtacgctgtctgcgacggaatggaggttttgtaaatgagtcctgtggtcagcatgttcatgtagatgcatcgaatcatacaccgcaaagcctgaaaaatgcactgacaattatgtatgcaaaggaagatatcctgttcaaagcattaaaagtgcaggaaagaagagcaaatagttattgccagagggtgcgaccggatgtattagagaaaatccgaaaaataccaaatagatcaatcactatggaccgagtaagaaatgtctggtatggaggtagggatggaagtcatacccattatgatcatacccgttattatgctctaaatcttcatgctgtgttttccaagggaactttggaatggcgctgttttgaaagcacactacatgcagggaaggtaagagcaaacattacactggcattagccatttccgcacaggcaatcaatcagagatctacacagatgaaaaagacactgatatcagaaaatccggcatttacatttcgtacatttttattgagacttgggttaattggagatgaatataaaaatgtccgaaaacatctgctggcaaatctggatggtgatcttgcgtggagatatgataaaagcacgtatgagtgtctgaagaaaaatcaaaggacagaaggagtcagatagaggtgagaaaaatagaagagagatattacttcgcttatggcagtaacatgaatctggagcagatgaagtacaggtgtccggctgcggaagttgtggaaaatgtccggctggaagattatcggctggcatttcgaggaagggctccgggtaacggagtagcaacggtactgccggaaaaaggaagctgtgtcgaaggagtcttatggaaaatcacagaagcgtgtgagaagagtctggatttttatgaaggatttccaagtttttatgggaaagaatcaattcgtgtaaaaaatcgggatggtgtggagaaagaagtgtttgtatatatgatgaacgctccgcacaaagatgttccggcaaagccatcgaaattttatctggatggaattctggaaggatgtaaggataaccagattccaacggagtctgtcatggaagcggtaaaacgtaccagacaggaagtaaaaaaagaaaaaaatcgatatgcaagataaaacgtaccgcagaggaaacatcttctgcggtatttaatttaaaaaatctatttataataggaaggaaaagcacatgaaggttagaaaattaaagaccagaattgctgcttttggactggctgtcctgatgggcatcagtaccttgagcagtgcgaatgcgtttgcggccgaacagacaggctcggaacagcagacggaagtacaggcggtaacaagccagaaagatacatcggttacagcagatgatattacaaaagcggtttcggatgaaacattcgcagtggaaaccagtatggaaggaatccattatgatgcagaaaaagaagatgttacgcttgtaagtatcaaagatgagaatggtggagagtatcattctgacaaatcaggaacatatattgccacttatatggtcgttccaaaagataagagtgacagctataccatcacccggaaagtgactctgacggatacagaaggtcaggcacattccgaagaaaatggtggagagaaacagaagtcagatacagaatctgaagatgattcggattcgcctgtgcagaactacacagatgtagaaattgaaacatccgaagaagatgcatctgcacaggcagtcaaagaactgaaagaggacatcgaagagggaaatgtgatggtattgtctgcggctgaaagagctacaagcagcggttctacagttacattgacaaaggggagaactatttattatccaagctatattggaaattatcttacttgcctgtttacagtcaatggaaagattgcatactgccttcagtcccagaaagcatccccaccgagtggaagttatgtagcacaggtactggacagcaataaaaatctgcagaaagttctttattatggttatggtggggcaggagatctgacagggagttatctgtttggaaaaacggaagatgaaaagtatgtgtatacacacattgcagccagctacgcttatgcaggagaagccggatttacaggatgtaattataatgaccttgtaaatgcaggggttattgcatatatcaattatctgttcggacaggaagaaccgccaaaaggtgaactgagcttttcaagcacaaagctgaatgcagtacgggatggaaatatccagaaaacaccaaatatcacattgtctggagatcacagaaactatgtgacactgagtgtaccggaaaatgtgacagcacataatctttccaaaggaacaagtgttacaaagggaaaaatccagatttatggtggagatacattctatctgtctgcggatttattactgacaggcagttatgcttccggcaacttatatggttctgtcggaaagacatggagaacactggtgctgacaaccggaaattccaagcaggatatcggtgtatttgaaagtgaaacagcagctccggtaagttttagtgtacagtggctgaatatgacacgcattgaacttatgaagaaagatgtcaatacacagaatccactgtctggagcagtttatggtatttataccgataagaagtgtgaaaacctgcttataacaatgtcagcaaccggaacagatggaaaagcagtcagcgattattttgattcagcactgaaaactgtgtatgtaaaagaagttactgacccgacagggtacaaactgaatacagaagtatataaagtggatgttgcagccggaaagacattgtctgtaactgcaaccgatgagagagtcacaggaaaagtaaaaatcgcaaagatcgataaagaaacacttgcatttaaagcacagggtgacagtgctcttcgtggtgcagtctatggtctgtatgcaaaagaggacatcgtgcatccggatggtacaacaggagttctgtataaacaggacagcctgattgcacagggagtcatcggagatgacggaacactggaattttcagaattataccttggagaaatgtatgtaaaagaaatcactccaccggaaggatatacgctggatactacaaaatatgaggtatcagtaacttatgaaggtcaggatgttgcggaagtgacaagagaccttacggtaaaagagcaggtaaagaaacaggcattccagttgatcaaaatcagtgaagatggagagcagacagaaacagacctggttgcaggagcaggatttaaggtatatctgatcagcgacctgacacaggtaaaaaatgggaaactgaaacctgccaatggagaaagctatacagcaaacgatttcaaaaattatgacttcagcaaagagcaggttgcagttacttatgagaacggaacagccgtaccagtaccggaactaattactgatacaaaaggatatgcagtcagcccggaactgccgtatggaagttatgttgtagtggaaagcactacccctgagaatctgaaaaccattgatccatttgttgtaaatgtggaaaatgacagcagagagccaatgcagtggagagtatttgatgaccgcccgtttgaatttttgctgaaaatcgtaaagaaggatgcacagactggaaataccgttttaaaggctggagcatcttataagatttacgatgtaacaaataagaaatatgtggaacaggttgttcagtatccgaagaaagaaaagatcagtgtattcaaaacaaatgaggaaggatatctgatcacaccgcaggaactgaagtgctctacctaccgaatcgaagaagtgaaagcaccggaaggatttgtaagacagggaagcgaagagtccctgtatgatggaacaacgattatttcaccattagagcagactacaaaaggaacatataaagaaaatccacagagtggtattgtaattacagtatcctcaaacactgcacatcagattgatccggatacaggagctgcgattgtagaggtagaacagaaaaatgacgaacaggtaggaagcctgcttctgacgaaaaagggagaacagcttaccgaagtaaccggagattctgttctggcaaaagtaaaagcactggtttctaaagtaagaaatgccgtatctggtaaagaagaaacaggtatttataaaggctttaaatatgaagaaaccggagtagaaggtgctgaattcgaagtatatgccaaagataccatttattcaccggacggagcaaaggacgaagaaggaaatccagttgtccgttatgagaaagatgacctggtagccagactgactacagatgaaaatggaacagcagttatcaacaatctgccactgggaatgtattatctgaaagaagttgtagcaggagagaattttgtcctgaatacagaacagaaagaatttaccctgacagcagaggatgatacacaggcagttgtttatgaaggcgttacctataaaaatgaaagacagaaagtttccgtatcagtagaaaagaaagattctgtcacaggcgaaaagctggaaggtgttatttttggactgtatgctgcagaagatattctttctaatcagggagaggttctcgtagagaaagataccctgctggaaaagaaagcaacggatgcaaagggaacacttactttcgacagtgatcttccacatggaaaatactatgtcaaagaggaagtcagaaaagccggatatcttccaaatgaggaagtatggaatgtagatgcaacttacgaaaatcagaatcttgcaaagattgaactgaacaaagaagttgagaatcagccgacagaaacacgcattacaaaaacagatgcaacaacaggaaatgagctggaaggagcaaaactgcaggtcattgataaagacggaactgttgtggaagagtgggtcagtacgaaggaagaacatgtcatttacggactgccggaaggaagttatactttacatgaggaactggctccttatgaagatggctatgtgtccgccagcgatgtgacgtttgaagtcaaagaagatggcagtgtgacaaaggttgagatgaaagatgaatattccaaagtggaaatttcaaaaacagaccttacaaccggaaaagaactggaaggggcaaagcttcagattatccgcaaagacggaactgttctggaagagtggattacggacggaaaaccacattccgttgaaaagctcccagtcaatgaagaacttactctgcgtgaaatcacagcaccggatggttacgagattgcggaagatgttacattcacattgaaagatacaatggaagtccagaaagtagaaatgaaagatgccagaacaccggagaaaacaacagaaaaaacaaatgcaccaaaaacaggtgacaaccagaaagtatgggcatttgttctgcttgcattgacatctgccggaacagctacgggagtgactgtataccgcagaaagaagtcaaaaatgacagacaacaaagaagaaacagaagaaaaataaaataagaattacaggataaaccaatttgacagggcaggagatgtgcataaggcagcttctgccctgtttgtagataaggagaagaatgatgagacgtttttatacagcagaatcagtaacagaaggacacccggacaaagtatgcgatcagatagcagatgcaatcttagatgaatgtctgcgttatgatccatcttcgagagtggcgtgtgaagtccttgccacaagaggaaatgtgtttgtagcaggagaaatcagcagcggatatgagccgccagtgtttgatgtaatccgaaaagttttagaagagtgtggatattgtacagatgggatagaaatggatacgtttgtacaccagcagagtccagatattgcgaaagcagtgagtgtgtcgaaagaatttcgggataatatcggcgcaaaaataagagacaggagcaggggagctggagatcagggtgttatggtcggatatgcgtgcgatgagactccgcagcttatgccaatgccgactgttctggcacaccggatcacacgtgaactttcagcttgcagaagaagcggatatatcaaagatatcttttctgatggaaaagcacaggtaaccgtagaatatgaagatggaaagccagtgagactggaaagtgttgttgtttcctgccagcatggtacagaaaagagtctgaaaaagttagatgccgagatcagagagaaggtgcttcgcccggcactcagattactgcctccggatgaggatacgaaaattctgattaatccgtcagggagatttgtgtgcggagggtttgatgcagataccggactgaccggaagaaagctgatggtggatacttatggcagtatggttccgcatggtggcggtgcattttcaggaaaagactgttcgaaagtagaccgttcggcggcttatatggcaaggtatatcgccaaaaatatagtggctgctgagtttgcaagcaagtgtcaggtgtctttggcttatgcaatcggagtagcagagccggttatgattgaggtagacacctttggtacaggaaaagtgtgtgcggatgattgtctggcggcagcaatcccactggtgtttggagtgacacccgttcagatcatggaatcccttcgactgaatcgtccgattttccgtcagacggcagtttttggtcattttggaagaaaggagtttccttgggagcggacggataaggtactggctcttcaggatgcaattctgtaatgccttgggtaacggaagaagagattcaggcagcaaaaaatatgactgcgtatgagtatttgcgaacgcatcaggcacagcggctgcaaaagacaaggaccagaaatgaatggcagttgacggatcatgacagttttaaaatcaatgaactgtccggcaaatggcattggaaatccagagatatcggtggcgtgtccgcactgcgcttcctgattgaagtagatggaatgaaatttacagatgccgtaaaactgttgtgcgaagagagtccgtcttttattccgacacaggctgtggaaagggaaaaactgccatttaagttgccggagaggtattgtaattgcagacgaatcagggcttatttaaaccacagaggaatcagcgatgaagtgatcacatattgtatttcacatgaaatcctttatgaaagtgtcccgtaccataacgctgtttttgttgggaaagatgaatccagaaaagcaagatatgcattcctgcgaggaatctatgaaaaaaacgggaagggattcaagatggagcagaccgggagtgaaaaaaagtacagcttttgcattccacctgaaagagaaacaaagcgagttgccgtatatgaagcgtgtattgatgcattggcacacatgacactggaagagggaaatagggataaatatcgtctttcccttgggggaatcgctgctccgaaagaaaacgcacagatacagagtgaacgttttaaaaagccaccggacgcactggaagagtttctgaagaaccattcggaaatcaaagaaattgaaatctgtaccgataatgactttgcaggaagatgggcgaaagaacagatgaaaaaacattatgagggaacgtatcagattatctgcaatctgccgaaaaaagaaggagcagattatgcagaccttgcgaaagaaaaaaagcaggcaaataaatgcagggacagaccattagaaagaaggtgatagagaatggaagaaaaaggaacgatacacgtacatctgttgacggagctgactggaaatctttattcagaagaatccgaatgggaagaagattggtcggagagtgatgaatatggaatgccgttagatggaacagaacttgccgattatgaagatgccatccgagaagaactggaacgctatggggaagatgatctcatgcagtattttgatggaagtgagtccattcatggaaaaatacaaagtgcagttgttacgatagaaaacaaagatggaatcctgtacggctgtaccaaactggaattaaatgaatttttaagtcaggaagaactacaggaattcaccgaatacattacagggcagtacagtgacggttggggtgaaggatttgagcagagggatatcaaggtagatggtggaatgctgaatgtgcatttctggcatcctgatatggagcagccgaaaatctatgaaaagaaaacagagcagatcccgataaagcctgagaaacaacgtcccaagttacaactccttggacatgatgggaatattttttccattatgggcgatgcctcaactcttttgaaaaagaataaacagacagcagaagcaaaagaaatgtgtaaaagggtattggaaagtggggattattacaaagcacttttgattatcagcgaatatgtggaaaccgagttgagtccaccaccaaaagaaaataaaaagacaaagaagaaaaatcagccggaacgctgagaaaagaaaggatgatgcctatgacaaatggcctgagtttggaagaacttatgaaagaggaaacatacccggaggaatatgctgaaggggaaaactggaaaatattacatggagatacattaaaactggtcaaagcattccagccgggaatctttgatgcagtcattaccgatccaccgtatgcgtccggtggaacaaagcagaatgaaagaaatcgtactacaaaccagaaatacagcagtatgagtgctgcaaatgcacttccggatttcgatggggataataaagaccagagatcttggacgcattggatggctgaatggctctatgatgtgcggaaagcctgcaagaaaggtgctccgatctgcctattcattgactggcgtcagtatccatcgattaccgatgcattgcagtgggcaggatggatctggagaggaacagcggtgtgggataagggaaactcccgtccacagaaaggtcgtttccgccagcaggctgaatacattgtgtggggcagtaacggaccgatgccaatcaaccgtccggtatcttgtctgccgggcgtcttccgatatggaaatccgcagaaccggattcatgtgacagagaagccgttgcagcttatgaaagatgtcatccagatttgcgaaccgggaggtctgatcctggacccgtttgccggagcaggaacgactgtccttgcagcggttatgacaggctatcgtgcagtgggaattgaggtaacagatgcctactacaaactgggaagtgacagagtgaaaattgcattagaagcagagcagaaagaggatgaaaagtagccgggatgtccaattggacatcttgttttttatagagaagatgagtggcatccaactggatgcaggaaggagatggagcgtatggaacaggcgctggcttatgtgtgctgttcagcagaagaaagccgggtgaaagtacagaaatattgcagaaaaatctatgaacttgggtatgtaccaatctgtccgagatttgtattctcaccattcttggaagaatccgatgcagaagatatgcagggatatggaagaatgtcacatatccttttgcggagatgccggatggtagtcgtatgtgggaaagatgtgacaggaacaatgaataccgaaatcagtatggcagacagactccatatcatttgtacgacacttgatggactggtacagataaaagaatcaaaataaatcagaagcgggtaaatccggtgctacagaaactggcggtactcgttttgcaagcatagcgtttggatatccaaacgcactttggggagaaccccaatcccccggacacagacggaaatggaaaggaaggatcaagtcatgttaagaaatggagtaatgattgtaatcgcattgatgagcggaggatttataggagtgatagtgacctgttgcatggttgcagcgaaaaaatccgatgaggatcttggcggtatgatgaaagaggaagagaaaaaagaagggacggtgatgcaatgcgaaaacgaaaccatgtgatcccggtgcggttaaatgcaagggaactcagggaattggaggaacaggtggaaaaaagcggactgagtcgggaagagtttatgcgttcgctgatcttaggagcgcaggtacacgcaaaaccctgtgagcatcacccggaactgcttaggaagatagcgggtctgtgcaataatgcgaaccagcttgcccatgttgcgaatgcttcgggaatggcaagtgagcagagtgtgcaggaaatgctccggcttaccaaagagacatggcatctggtaaaggaagagtggtaatgacagatggcttatacaagtgttatccccgtccaccgcctggaccgttccatcgaatatgtgaaagacaaagaaaaaaccacacagaaagcagactctctggaggctgccattgattatgccatgaaccggacaaagacggaacaggcggtcttcgaagataccatcggatgtaccaatgaaaatgcgtatgcagatatggtggcaacaaaaaagagattccataagatgggcggtgtggaaggataccatctggtacagagttttgcagaaggtgaggtgacaccggaactggcacatctcatcggacaggaactggcagaccggctcttaaagggacagtatgaagtcgttatcacaacgcatctgaataccagacattatcataaccacattgtctggaactctgtgagcatggcagacgggcgtaagtaccacagcaatgcaaagagttattatacggagatccggaagatctccgatgagctgtgcagaaaatatggtctgtctatcattgaatccgaccagaaaaaatcaatcccttatgtacagtggaaagcggaacaggaagggaaaccgacatggagaagtgcgatccgtctggatatcagggagtctgtacaggaaagctactcctggtcacaattcttaaaagaaatggaaaagcgtggatacacatggaaactgaaccggaaatatgtcgctttaaaggctccggggatggaacggtacatccggctacggtctcttggaaaaaactattccgaagaggagatccgtggacagatcttacagccaaaagtaaaacgcatctatcaaaagacggtgcagatccctccaaagaggaaactgaccgggatacaggcattatattattcctatctatatcagatgggagtactgccaaaaagaccgagaagaagtccgtatgccatcagagaggatatccggaaactggatcagaggattgaacagattgagtttttaatgaagcatgacattacgaccagagaacagcttgctacataccgtgagccgttacaaaagcagatttcagaactgatgaaggaacgcagaaagctctatcggaatgacagtgaagacagtggaaaagtacggctgtccgaaatcaatgaggaattaaaaaatctccgaaaagaagtccgtatgaccgtccggattgaaaagcattcattggaaatcgaagaaagacttcgaaaggcagaagaacaaaaccagaatgagaaacgtgtggaacacaaagaaaaagagagtcaggaggtgagataagtatgaattacggagcagaaccggctgatcaggtggtgcggtacagtctggaaggaatggaatactctttgaagattaccggaaatgtggcaaagcatgtggcaatctttattgcagccgccctgaaagatcagaaaaagacaagagggaaaacaagacttaccagaatgttaaaggaacagcgcccgatgaaattttttactgttccgggtgaccgtctgaaagaatttgcaaaagaggcaaaggcgagaggtatcttatatgtagtcatcaaagataaggtgaatccggaccagacagaggtcatggtatttgcagatgatgccgcgaagatgaacagggtactagaccggatgaatctggattttgtaaaagcagaatcaggctctatggttacagaagcagtggaaagagtgactgcaccggaaaagacagaaaatcagatggaaaaagaatcaagggagaatgtacggacagagaccgttgtcctgccggaaggcaagatagaatttgaactggatgatgcggaagaaatgtttcagattggggatgaggctttcccggaaggaaattttacacatgcgcaggaggggaaagcaaagaatccgtccgaacctttctcgcgcaacaaaaatatttcttccggtcgggaaactagctgggaagaaaagaatgaaaaaccatctgtgcggaaagaactcggagatatccgtaaggaacaggaagagaaacgtaagaggccggacagacggaaaaatgccagagagagcaggaagaaacgtaagaatatgaaaacgaaaggcaggtaatgtatatggatttaacagatatgatttcaggtggaacggaagaacagcagattcctgaacagaaattgaccaaggaagaatatgcagccaagaagcagcaggaaagagaagaggtatgggctgaagtagattcacaggcacagggagtttttcaggatggagaaaaactgaaaggctttctggattttatggcagagtgtaatacacagagaactccgaatctgcttttgatctacggacagcatccggattttaaggtggtaaggtcttatgaacgctggagagaagaacaccgttcagtaaaagcaggggagcatggcattacttatatgatttccactgaatacgaaaaagacggagaaatgcggagagggtatacgatcggaaaaggatttgacatcagtcagatgtcaggaaagccattggaagaacgccctcagcgaagtctgacagaactgataggaactgtcttaaaagaccagtcggtacgtgtgcagattgaggatgatctgccagacaaagtgcaggcccagtacaatccgagataccgtaccatttatatccgcaacggaatgagtgaagtaacgacattccatgcactgaacagagaactggcgtgtgcagcactggaccagcataccggaacctacagccgacagaaagtcagtgcacaggcttattgtgcagcctatgtgattgcgaaacgttatggtgtggatgtcaccggattcaatctggagtatattgcacagaggaatgaatgcggaaagaaagatccgcaggaactgagagactttttaaatgatgtccgtcaggcttcctacagtatacgaaaccatatcgaacgcaattttggtgcaaaggaacaggagtatataaccgatgagttcgcaatcggagaccctgtaaaaataccggaaaccaaggatgaaaaaccatctgaaaaagcatccggaaaagagaaaaaagcaaagagccaggcggaacgataaaagtgaaaaagctggacggttggagtagctattacggaggtcttgtgatatggttggtgtaacaaaaaaaggaggtcagccagatgacaaaatactatttgaagatggataacattatgaaaaatatgttcgtggtggcactgaatgatgagctgcaggcacagaatgagcaggacgaatgtttggaagagacgaaagctcttctgaaaaaagtaagtgaatacgacctcgcccagaaacggctgcagattacagtcggggagcagaggcagatccgtaaggcactgaacagactcagaagtaaatatcttgcagccggaagatacagtgacggaatagataaagtcatccttcaggttgcaaaaccgaataccaccagacacatgttctggtagagaaaggagtggttgattggtcatttattcaagagaaaaagtggcacgacttagagaacagtatccggcaggaacaagaatctgtctggattcgatggacggagaagcgggtatgccgcagggactggaaggaactgtgcagtatgtggatgatgcaggtcagctcggtgttaagtgggacaacggcagaagtctctcactgataccgggagtggattcctttcataagaaagaaggacagggacatccagaagaaaagccacgcaagaaaagagaatctgacttgcagagataagtacaaaaaagcaggactgggttctgtatcttgtttttctgccatttgtctggtgggcggcagcgattaccgcttgtgccattacaccggataagaattttattcaaatcttagaaacgctgagcgaaaaactcgaacagccgttttttatcacgtatacaccgtatacgttcaaatgtattctgatattcacagcagcctatttcttaggcattggtatttatgaatcccaaaaaagaaattatagaagaggcgtggaacatggttccgcaaaatggggcaacgtgtccgaaatctgcagacgctactgcgaaaaacaatacacgcagaatctgcttttaacacagcatttccgcatgggactggacggctataagcacaaacgaaatctaaatgtgctggtagtcggaggttcgggagcaggaaagagccggacgtatgcaatcccaaacatcatgcagtgcaactgttcgatggtgattactgatcccaaggcagaacttttgcgtaaaaccggaggtgtcctggaacggaatggatatgaagtccgggtttttgatttgatcaatccggagacttcctggtgttataatccgtttgcgtatgtccgggatgataaggatgtactgaagctgatcaataacctgatccgcaacacaacaccaaagggtgcgcagagctcagacccgttttgggagaagtccgagactgcacttttgcaggcacttatgctgtatttgctgcatgaagctccaccggaagaacagaacttcccgatgatcatggaaatgcttggaagcgcacaggtcaaagaagatgatgaggattaccagtctccattggacattttgtttgaaagactggaaatgcgggatccggagagtattgcggtcaagcagtatgccatttataagcaggcggccggtgttgtatgctctaaaagacttcttaatcaagcggttgggaagtctcttagaacacacaacctaaaaccgaagaaaggagcgcaagttatgagaaaaaacgagaaaatcactgctctgtacgaacgactgagccgtgatgactttggcaaagatgatgaccaacagcgtgagagcaattccatttccaatcaaaaggctatgttggaggagttcgccgcccggcagggctttacaaacattgtccatttcacggacgatggcattagtggtacttgctttgaccgtcccggatttttagcaatgatgaaagaagtggaagccgggaatgtggagtacctgtgtatcaaggacatgagccgcatggggcgtgactatctgaaagtcggtcagattatggaaatcctgcgtcagcgtggcgttcgccttatcgccatcaatgacggcgtggacagtgccaaaggggacgatgattttacccctttccgcaacattatgaacgagtattacgccagagacaccagccgtaaaatccgttccactttccagtcaaaaggcaagtccggcaagcacctcacaggcacggtcatttacggctatctctggaacgaagccagagaccaatggttggttgaccccgaagccgctgatgtggtcaagcgcatctttgccatgacgattgacggctacggtccgtatcagatcgccagcaaactgaaatcggaaaaggtgcttattccgtctgcttaccttgcccggcacggcgagggcgtgaacaaaaacaagactttcaaagatgtgtacggctggggttcttccaccatctgcaacattcttgaaaagcgtgaatatctgggacacaccatcaatttcaagacccgaaagcacttcaaggacaagaaaagccattatgtcccggaggacgaatggacaattttcgagaatacccatgagcctatcattgaccagcagacctttgaccttgtgcagaaaatccgtgggaatgtcagacgctacccggacggctggggcgaagcagctcccctcacaggcttgctttattgtgccgattgcggcggcaagatgtatgtccaccgtaccaacaacggcaagcgtatttctcaatatacctgttcccaatacagcaaagtcccagttggaaagctctgcaagacccagcaccgtatcaatgaagatgtggtactgtcccttgtctctgaaatgctcaaagccattgccgagtatgcgaagcatgaccgagccgagtttgtccgtgtggtgcaggaagcgcagtccagccagcagacagcagaggttaagaaacagcggatacgccttgccaccgcaaagcagagagtgtcggagctggaagtcctgctctgtaaaatctatgaggacaacattttaggaaagctgtccgacagcagatacgccactctggacgctcaatacgaaaaggagcagaccgagcttaccgctgaaatctctgctctggaaaaggcagtcaagagctacgagaagcacgaaaaggacgctgaccgttttatcgctctgattgacaaatacgagaacttcgacaagctgaccattgctatgctcaacgagtttatcgagaaaatccttgtgcatgagcgtgaccgcaaaggcagtatacagaccacacaggaggtcgagatttacttcaattttgtcgggcgatttgttcccccggcgtttggagaagtggagctgaccccggaagaattagaggaaatccgcaaacgtgaggaacgcaaggacaggcttcatcagaactacttgaagcgtaaagccagcggagcgcagaagcgatacgaggacaaaatcaaggggagaaaaaaggcagaaatcgaagccaagaaagccgctattcgtgcggaggatattgcaaagggagtgttcgtccctgtcagcagtttaccgcagagagagccgatgaaaggagtacaaacagcatgaatatcacttatacacagaacggcgattatcttatcccgaacatcgttatccgcaagaccaagcccctcggacactacggcagacttcgcaaggcgtatctggaaatgcaccgtccgatactgttcaatgagctggtgctatccgacaagctctttgagcattgcgccgagattgacgaagcggcacgaaaccgcatggagctgatcgtgcggtcactggcagagcaaaacggcgtgaccgagcaactaaaagccaaaaaccaaatggaatgggtgcggcagatgaacgcttgcaaggcacaggcagaggagattgtgaaagcggaattgatttatgattgagcgaggaagtccgggcagaaaactgttcggacttttctcatgtagtccaaagttgcggtagaattgttcacgagttttatggtacaatttatgcgaataaagaaaacggaaaattagaatctaacaagagaatgtggttgtatgaaaaaatccatattagtattttgggcaatcgtgtgtctgttacctattcaaaggaggtttaagaattttaaatgaaacatataagaaatatattgctgttgattacgattatttttgcttttgttatgcaagctgaagtatatcaaaatatgctctggaactttaatggtgcttattatttatcgtccagatacacaactactaatgacgatatggattcatttttagccaatgcagaagatacagctgagaagcatggtgttcatattttttcgacttttaatcagagagtttctaattatcagacaagactttatatttatggtgatgataccgttgttcgggatagtcttaaaagcacaatggatattgaggaaaaaacatatacggctttgataggcggaatcaccgtaatagaatttgaagattttagagaagcaaaaaacacaggcaatggacaggaaataatggtcagctatatcggtgacgatgatgacattattgccacatatcaagatttggcaaaagaatattctatatcgcagccagagttttggcaatcaaccgaaactgatatgatgttcattgtttggggcctggttgccatattgatgattgtacttaatatgattgaggtgatacgcagacaaaaggaagtagttgtacgagcttctctgggcgaaaatgctgctgtgattgctctaaaagctgtagtggctgatatgatttcatatgctgcattattcgtcttagcaaagttgcttgtttctcaatttatatcgggagcgtatgaagatcatctcattttggcagtgtattgtgccggagcagttctttccgtaattccttatgctgcttttgtccgctttgatgtaaaaaaagcctttgccaatgcttcagataaaaaaggtatgttttatcttctgaacggtcttaaagtatttgctactgctatgacgatttttacaataactacaaatctcagtagcattcaaggtaatttacttacaaacactactcttttagaaaatcattataatgattactattttggagttatgcagattgaacctccttttgaagaaaatgaggaggaatccaaagagagcgaattttggaatgacctttacgaaaatgaatacaacactataaatccggtggtctgcataggcagccggataagcgatacggataattatatttttgtaaatcataatgccagagatatgctgcaagggttttctgatatgcttactgaagatgatgaaaaagaggatatcgtggtcttcgtgccaaagggaaaaaatgcggaatcatacaaagatatcgcaaaagaggaaattgactctcttacccaaaatgcagaagaactgcgtgttgtttataaagaatattctggcagagagcaattttattatctcaattcgaacagagaagaggctattgacggattgtcaagagcaacaaatccgattgttatttatcaggcaaatgaggctgttgctttgaatggaagttatatcgaaacaggaacatataatggtgaggtgatctacggatgcgatgaaagcacaattcgtaatgctgcgaaaaaatatgcagaacagcttggtccacactattttatgctgacgaatgtcggggaggattatacttatagtcatagtttcctcgtgaaactgattggctttataagctctctttgcgtattagtattgctgttagatatcgctatcatcatatctgaagtgaaaatggaatttagacttaatgcgatggaaatctccctcaaaaaggttttgggctatcgcttttatgaaaggcacaaaagatttatttccgttaatctcttagaaaatatagccgttgtgatattgatttgcattgtttcgctttttatatctaacgcaagtgtcgggattgctttactggttggagcattgctcaccattattgaaatggcaatcattttcacaaatgttatgtgggttgaaaaaacaaatatctcaaagtccttgaaaggtggatgtttatgattataattcgtggcttaaataaagcatttggagagaaaataattttctccaactttaatttggaaattccggatggaagttttgtagtaatcagcggggatagcggcagtggaaaaagcactttgctcaatatgattggtggtatcgaaaagccggatagcggcagtatcataatcgaagggctgaatattacccggcttaaaaataaaaacagtttttttgcggatacagtggggtttctttttcagaattttgcactgcttgaaaataagacagttaaagaaaatttaagtttgattaaaaaatcaagccgaactaaagtatcacttaaagaagctcttaatcgtgtggggttatcaaaggaagttaacaaaaaagtttatcagctttccggtggtgaacaacagagagttgctttagctcgtcttatgatgaaaaaatgttctgttgttttggcagatgaacctactggctcacttgacaagaaaaatagagatattgttatgaggttattgcacgaactcaatgaagaaggtaaaacggttatcattgttacccacgatcagggtattattgaagatgaaccttatgttgtgaaaatctgagagtacctcttagaaatgtcttgatctacattttatgtaatttgggtcagaagaaaatccctttaggaactaaagggcgcacttctatactctcctatcgggagtatcgtgcgtcctgcggagcttcattcccggtcagcagaaaaaagctgcatgcctgagaatgtttcgtcacttcgttccatcaagggagctacactcccttgcgacgcttgtgcgtctatcccttgtggacttgccgtccgcaaacagcatgaaatgctgttcgccgccagcaagtttgaaaaaccgaataccgaaaatcagaccgttgactggtcgcaatgtgcgaaaagttgacggtctttttttatccccaaaatcaaaaaaggaggtcaagcacaatgacaaaaccgaaaacccttgaacagctccgagccgaaaaggaacgagctgagacaaggcttgcacaggagcagcacaagctggagcgtctggagaaccgaaagaaatttctggaacaaggcgaaagaaagaaacgcacccaccgcctttgcaatctgggcggcacgattgagagccttgccccggaggtcaaagatctcacacgcaccgaaatgacggagctgatggagtacatcttttctctgtccgaagtccagcgagccgtccgtcacatggcgattacccacatcaaccaagcgagcagaggaaaggagttgaaagccgatggcactatttcatctgagcgtcacgcagactaaacgaagcgcaggacagtccgctatcgcttctgctgcctaccgttccggcgaaaagctgtatagcgagtattacggcgaatacagcgactacaccagaaagggcggcgtgatctgctctgacattctcttgccgtcccatgtaccgccagaatacgcagaccgccagaccctatggaacgccgtggaaaaagccgagcgtggaaagaacgcccaacttgcatacagctttgacattgccttgcagaatgaattttcccttgaggaaaacatcgctcttgcaaggcaatttttattggagcagtttgtgagccgtggcatggtggttgacttcgctgtacaccagccagacagagaggacggcggcatacccaatccacattttcatgtgctttgccccatccgtcccatcgagcagaacggcaaatggggctgtaagcagcaccgagtttacgagctggacgaggacggcaaccgtatccgggacgcagacggaaagtttgtgttcaacgccgttcccactaccgactggggcagtcccgaaacgctggaatactggcggcagacatgggcggagctatgcaacgccaagtttgcggaaaaggggcttgacattcgtatcgaccaccgaagctatgagcgtcagggcgtggagcttcttcccaccgtccacgagggcgcaaccgtccgggcaatggagaagaaaggcatacgcaccgagaagggcgagttcaaccgctggatcaaggcaaccaatgccgttatccgggacatcaagaagaaaatcgctctcctgttcgattggattgccgaagcaaaagcggagcttgccaagccgcaggcacccaaccttgtttctctgctgaacgcctattacaccagccgcagagccggggcatattcgcagaaaggtaaggtcagcaacctaaaggagatgaacgagactttcaattatctccgggcaaacggcatttactcccttgaagatttggaaagccgtgtcagcgaacacagtgctgccacagagagcttgaagaaaacgctggacgaacagactgcccgaatgaaagcaattaagcagctctatgacagctccgctgctttccagagcttgaagcctgtctatgacggcttgcagaaaatcaagtttgagaagcccagagccaagtacaaggcagagcatgaagcggaactgaaacagttctacgccgccagacgtaagctgaccggagagttcccggacggcaaggtggatatgaaaaagctgaccgaagagtatgacgagctggaacaggcgcacaacaccacctatggcgagtttaagaccgtcagagacgatttacaccgtctttggaaggtcaagtcatgtgtagatactgccgcccgatttaacgagcgtacagaggaacaactgcaccaaaatcgaccccaaacacgacacaaaaaggaggatatatcccgatgaattacacccaagcacagattgaccgggcaaacgccgtcagtctggaagattttctccgcacacagggagagacgcttatcaaaagcggacgggaataccgctggaaagaacatgacagcctgaccgtccggggaaacaagtggtttcgccacagccagagcaagggcggctatcccattgattttgtcatggagttttacggcaagtcctttcccgaagctgtccagctcctgaccggcgaaagcggcgaggggcagaccgaagccagcacagcaccgcccacagcgttccacttgcccttgcacaacaggacagccgacagagcaattcaatatctcacagaaagccgaggtctcaacaaaacgcttgttgaggcttttcttctttccggggatatttacgaggacgcaaagcggcacaatgttgtgtttgtcggcagagaccgaagcggtacgccgagatacgcccatgtgcgaggaacggcagacccattcagacaggacattgtcgggtctgacaaatcctatccgttccgacacgagggtaatggcaatcagctctttgtctttgaagcgccgattgacctgttatcgtttatctgcctttatccgcaggactggcagacaaggagctaccttgccctgggcggcgtttcgggcaaagcccttgaccgttttctttctgaacgcaaggacacccgaaaagtgttcctctgccttgacagcgacaccgcaggaagtgaagcctgcacccggctggcacaggacattcccggcgagatcgccgtcattcgccttgtcccggcaaggaaagactggaacgatgttctccgtcagcaaggggacattcccagccgcaaattcatagccgagacaatcacgctgcgagagctgcccaccgcccagcctgttcccatgctccgcatggcagatgtggagctgacgagcgtggattggctatggtttccctatatcccctttggaaagctgacgattatacagggcaaccccggcgagggcaagacctactttgccatgcgtcttgcggcggcttgcaccaaccgaaagcccttacccggtatggagacccttgagcctttcaacatcatctaccagaccgcagaggacggtctgggcgataccgtcaagccccgactgatggaagcggaagcagaccttgaaagagtgcttgtcattgacgatagggacacgccgctgacccttgccgatgagcgcatagcaagggcaatccgggaaaacaacgcaaggctggttatcattgacccggtacaggcgtttctgggcgcagatgtggacatgaacagagcaaacgaggtgcgcccgatattccgcagtctgggagacattgcacaggctaccgggtgcgctatcgtgctgattggacacctgaacaaagccgcaggaacgcaaagcacctaccggggattggggtctatcgacattacggcggcagtccgcagtctgctttttatcggcaagctgaaggacagccctacaacgagggtgcttatccatgagaaaagctcccttgcgccgcccggacagtcccttgccttttctctgggagacgagaaaggctttgagtggataggggcttatgacattaccgctgacgagcttcttaccgggacagacaccgccaagacggaaagtaagaccgcacaggcagaaatgctgatactggaactgctggcagacggaaagaaaatgccgagtgcagagctggaaaaagcggtcaatgacaggggcatatcctcacgcacgatgaggacagctaaaagccgtattggagacaggcttgtgaccgagaaagacggcacagcatgggtctgctatctccgaagctgacgcaggaacacggcaagcatggcaaagacggcaaggtttttatagataccttaatgttgccgccttgccttgttccctcataccgacaccgcccgatgatgaacagtcaccgggcatttttcatttacaggaggattttgaatgaacaataccgcaaccaacagcaccccttgcccgactgtcagaaagcagatcggcaagacaacctatatcgtccgtgtccatttcagccagaccgccaaagagacgatggaggacaaaatcaagcgtatgcttcgtgaggaagtccgcaaaatgtgacttctttgtgaatttgatgaaaaagtccttgacttttcgtctctggaaagactgcaaagtcgattttaatctcggttggtgtccgtctggcagcttttaacctgaaacagatcgccaacctgacctgtacagacgaactggacttatacagcatcggggagaagaaagtagcactgttttgctgtattccggatgcggacaccagcatgaattatctggtcggcatgatttacagtaatctgtttcagacactgtattatgtggcagaccggaagtacggaggaaggcttccaattccggtacactgcattatggatgagtggccaaacgtagccttgccggatgattttgacaagattctggcaaccatgcgttccagggggatttcctgcagtatcatcatccagaacatcgcacagatgaaagccttatttaaagactcgtatgagagtctgatcggcaactgcgatgaatttttatatctgggtggaaatgaaaaagaaggacataagtatgtctcggaattattgggaaaagagacattggataccaatacctacggacagacaaaagggcgtagcggcagctattcggtgaattatcagcagactggaagggaacttttaacaccggatgaaatacggcttttagataaccgcaaagcgattttgtttattcgtggggagcgtccgatcatggacgataaatatgatttaaaaaagcatgtgaatttcagatacacagaggacggtggtgcatcgccttatgattatgcgaaaacaccactggctcacgacgacctaaagattgacattaacagattagacgactacgaactgctgtctaccgaggacatccttggtgaatagcagttttttgatggattggagtgatgtgtattgaagaaacttctcacaggagaaaaaaatagaacaaaaaagaatacaactgaaaaaatgacaaccccaatgccgatgggtagaaaacagaaaaagtggatgagcctttacatggcgctggtactgaccgtaacggttggagcaacgaccgcattcgcagccggagatccgttgtccgttatcaataacctgtctacctttattttttctctgattcgtgcgatcggtttgattttgcttggatttggtgttgtgcaggttggtctgtctttaaaaagccatgatccaagccagagggcaaatggatttctgacactggccggaggggtaattattacgttcgccaaagaaatcctcgatttgattatggcgtaagcctctttgaaaaaatatatcaggaaacagcaggagtgccggaaggtactcctgtattcaaaaatatgtttaaggaggtgagagtttttgagtgataactggattgtacagaatctaaactcagcactatccacatggagtgaaaagatggcagaactgtggactctgctgactgaaaatccggcaacttttaagggcggcggcatctggcggattatggtaaatattaatgatgcactgacagccattgcttatggattactggtattatttttcgcagccggaatcattaaaacgtgtggcagttttacagatctgaaaaagccggaacatgtgctaaaagcatttatccggtttgcacttgctcagggagcaattacatacgggatggaacttatgcaggcactgttttccattgtgcagggaatcgtgacaaccgtaatgagtggctccagtatggcaggaagcgtgacggaactgccaacggagattgtagataagattgagagtgtgggaatgttggaatccattccattgtggattgtcacactgcttggcagtctgctgatcactgtattgtcatttgtaatgatcctgacagtgtatggcagaatgttcaaaatctatatgtatacggcaatcgccccgattccgatttcctcatttgcaggagaacccacgcagtccatcggaaagaactttattcgttcttatataggcgtgtgtctggaaggggcaattattgcactggcatgcattatcttttctgcttatgcggcaagccctccggctgtcggagatacggagctgagtgcagttacaatcgtgtggaactatgtaggagaactggtattcaatttactggtgctggttggagcaattaaggcatctgaccgtattgtcagagaaatgatgggacttggaggttaaaaatatggatacaaagaaaacattaagatataactgggaatttggacgtgagacagtagcaatacgagcgagctcttatcggaacaatggaaatttatatgtaggactctgccataaggaagggagagaatgggaagattttggagatgtaaccattaatctgccttatcagttcttagagccaaatgaggcttttataacaggagattttaccaaggatatgcttcattttatcaaggaacataaacttggaaaagtgttgaatgaaacaggaagatcaggatatacaacctatcagaaggtagcgtttgatctagcaagacttgcggaatttgatccggaaggcgttgcggaacactgtagatttgccgggatagaagtaccgaaagaaaaaccacagaaaacgaagaaacaaaacaggggagaggaacgataatttatggaagtaaagatgaacaaagaaatcagggactatcaggaatccatgtttatgggactggacctgagacaatgtgtgtgttctgttcttgcgattcttacagcaatcggaatttactttggaatgcgtgatattactggacaggaaataaccggatggctgtgtgtgcttggtgctgctccatttgctgcctgtggctttttcaaatatcatggtatgacagccgaacagtttttatgggcagtgatcaaatccgaattgctgtatccgaagaaactggtgtttcagtcggaagatatctactactcctgcatgcaggagaccatctcgctgggagaaaagaatcaaaaggatggagcggaaatcataaaagagcgggagcaaatagcagaagcaaaacagagaaagaaacgcaagggaaggagtgatgcctttgattaaaactttaagtcaggcacttcggatggataaggaacgcttcaaagttccgaaatccgtccaacaggcaattcccatccagcgaatctggccggatggaatttttcaacagggaacgaaattctcaaaaacatatcgttttacagatatcaactattatattgcgagtaaggacaataagacagaaatgtttctggattattccgaactcttaaatgcactggattccggcatttctgccaaaattaccatcaataaccggagaatcaataaagaagaatttgaaaaatcaatcctgcttccaatgaaggaagatggactggaccactatcgggaagaatacaacgaaatgctcctgtctaagattacaggaacaaacaacagcatctatcaggaacggtatctgactgtcagtgtacataaaagatctattgacgatgcaagaacctattttgcacgtatcggaacagacatcgtaacacatctggcaaagttatcgtccacagcagaaggactggacgcagagagccggctccagatcttccgggactttttcaaaggagatgtcccacaggcatttccgtttgatctgaaacaatttgccaagaagggaacaagtttcaaggactggatgtgtccggattctatggaatttgaacgtgaccattttaaaatcggtgacaggtacggaagagtcctgtatatgcaggattatgcaagttatgtcaaagatgacatgatttcagaactgtgtgacttcagccggaatctgatgttgtcgattgacatcctgccagtccctacggatgaagcagtaagggaaatccagaaccgactgcttggtgtggaaacaaatgtgaccaactggcagagaagacagaatgcaaacaataacttttctgccatcgtcccatacgatatggagttgcagaggaaagagacaaaagaaatgctcgatgatctgacaaccagagaccaacggatgatgtttggaattctgacgatggtacatctggcagacagtaaaaaacagctggattccgatacagaactgctcctgtcggtggcaagaaagcatctgtgccagatgtcaacactgaagtggcagcaagtggacggactgaatacagtgctcccgtatggactgcgtaagatcaatgcgctgcgtacactgacaacggaatctacggctgttttaattccgttccatacacaggaaatcctgcagccgggaggcatctattacgggcagaatgcagtcagtaagaatctgttggtagccgaccggaagaaactgatgaatggaaacagtttccgattaggtgtcagtggatcaggaaagagtttctcggcaaaagaagagatcgtgcatctggcattgagtaccgatgatgatatcctgatccttgacccggagtccgaatttacaaaattagtagaggctctgggcggacaggttgtaaaagtatctgcgacatcagacaatcacctgaatgcaatggatatggacgcagcctacggcaatgaaaagaatccactgattgaaaaatcggagtttatcctgtctgtgttcgagcagttggttggagcaggaaatctgtcggcaaaagaaaagtcgattctggaccgctgtgctgcagatgtgtaccgggattatatccgaagtggttataccggagaagttccgacattgaaagatatgtaccgacagctgatgttacagccggaagaagaggcaagaggactggcattatcatctgaactttttatcaatggaagcctgaacacctttgcacagccgaccaatgtgaataagaagaacaggatcatggattatgacatccgggaactgggggaacagctgatgccgcttggaatgctggttaccttagacagtattttcaacagggtaattcagaactggaaagaaggaaaaacgacatggatatttgccgatgagttctatctgttattccgctatgaatacagtgcaaatttcttctaccgactttataagagaatcagaaaatacaatggattcgtgacaggtttaacccaaaatgttgaggaacttctgaaatcggacactgcaagactgatgttggcaaacagtgagtttttgattcttttgaatcaggcaagtacagacagggaagaactggcagctcttttgaatatttccgaaaaccaactgtcctatattacaaatgtatcggttggtagtggtctgattcgttgctctggaaatatcgtaccatttgagaatacgttcccaaagaatacagacctttataaactaatgacaacaaaaccgggagaatcataatgaagaaaaaagaagaagtaacgataactttttatgctgcagagtgcggtgagttccatgatttaggagaatatacaaaatgcagaacgttggaagaggcatataaaaagtaccagaaatattgtagaacatctgccaatatgtgtccggctattgagttttccatccatgatccgtactctatttattcggatatggaatatccattgccgttgtcatcaaaagacaggggtgatttggagcttgtgccatattacaacgagcatccactggtaaatgaagcaatcagacagttggagcagttgcagaaacagcaggaaaaaaagaaacatcgggatgttgcccgatgagataagagatacggaaagagggtgaccggatgagagatatcaaggaacgggtaagggataagaatccgaagattcgaaatccggatgcccggcttccgaaagaactggtacgctcggctgtactggaagcaaaagaaaagccaagggaactacatgagaaaagcagtggtcagtcagactctccaacacagtatggcattgaaaaaatagaatccgtacagtacagggcggcgagtgtggcaggaaaaaccatagggaaaaccacatatcgaggtgggaaaaaacttgccggagtgacctacaggaagataaaggaaagaaaacgcagacaggaagaagcgaaagctgccgaagaagcaatggagcagggggcagaaagcggaaagaaattgatcaagctgaaaccggagcaggcagcacttgccaaagaaaacggtaaacggcaggtaaaagcagcaccgagagtggtaaaagtatctggtctgtctcaagaaaaaatcaagacacaggcatccgtacagacacagcaggtggaaaagagccttcaggcgatgcagaaagcaagagcagtccagatggcaagaaaatcagcacaggcatcgacagaaagtggaaaagcagtccttcaggtaacaggaaaaggctcaaagttatccgtaaagggaattacagcagtgattcaaaaaggggtagtagctcttgaaaaaatgggaaaatggattgctgccggaggcggtgcatttcttctggtatttattctgattgcaggaatcattgcaggagcagccttcagcagtagttcggaaaactccgaatctctaagtgatgaggtgctggcttatacttcggtgatgcagcagtatgcatcccaatatggcattccagaatatgtgtctgcgatacaggcgattatgatgcaggaatccgggggaagaggaacagacccgatgcagtgttcggaaagtccgtacaatacaaggttttcacacagccccggttctattaccgatccgaattattcgatagaggtgggagtacagacctttgcagactgtatcagtcaggcaggatgcagcagcccacaggatatggacaagttaaaacttgcatggcagggatataactatggaaacggatacatagtatgggcgttgcaaagaggcggatacacagaagccaatgctttacaattttcacaggagcaggcagcttcgcatggatggagcagctatggagatcccgaatacgttccccatgtgatgcggtattattccggtggcagcctgtttgctggtttgtttggaagtcagcagattgtatcggtagcaatggggcagatcgggaacagtggcggccagaagttctggagctggtatggattcgacagccgagtagaatggtgtgcctgttttgtgagctggtgtgcagatcaaagcggtctgatagcaagtgggaatgttccaaagttctcattgtgccgtgatggagtgtcctggtttcagggaaagaataagtggcagagtggtggaacaaccccgacagccggaatgatcatctttttcgactgggatcacgacggaacatcagaccacgtaggaattgtagaaaaatacgaaggtggacgagtttacacgattgaaggaaattccagtgatcaggtacgacagaggaactatgcggtggattatgcctcaatcataggatatggggtgataaattgatggtttctttcataatttgttaaggattttataagggagttaatgaatcctttggaaaatagtcacaaaataggcacagttgattgataaattgttattgtaacttttagtgatagacatataaagagttagaaatctttataattgacttgaattaggaggtagtgaatatgagtgatcagaatgtaaaagcagcacaaaaatatttaaatgcgatgtttggtggacataaggattgggtaaaactggatgaagatggaaagaccggaacagccgtgatgcagggaatcattcgtgcatttcagattcagaatggaatctcaacgattacaggaacggttggaccacttactattaataccatgaagaagttagccattattacaaaaatggatccgaatgatactccgcaggttaatgtatgcttgattcagtgtgctctgttttgcaaaggatatgctgctggaggaattactggaatttattatacatcaggagtaaatgcagttaaaaagatgcaggaaaatgcaggactggaagttacgggcaaaattgattggaaagtttggtctggattgttatccctaaactggtttacaaaggtttctggtggggattccaatattgttcttattcaacagcaattaaatagtgattggtcagatgttattggtgttggaccttgtgatggaattgcctcaagacagacaattttgtctttagttggtgcattgcaggcggctgaaggagttacaactgaattaattacagatttgaattccgttaattttggcgatgcaacaacaaatgcgtttccgggtacattacagaacggacagaactcgatgaaatatgttccatttaataagattgctcaatacggactatattttaacggatataatccgggaagattcgatggcgtgtttgattcgactacagagtcaaaggtgtcagaatttcaggagttttatggcctgacaggaattggacttgtaacaaaaggaaaagtaaatgtttctactatgaaatcattgcttacgagtaaaggcgatacaaacagggcagcaaaagcgtgtgactgtgcaacagtattaaataaacaacaggcattagatataaaaaatgcagggtatactcatgtaggacgttatctgacaggttctgttggaaaagagcatacaccgaaatatctgacttctgcagaagtaaaaaatatagagaatgcaggattatcagtatttccgatatatcaggatgggggatatgaattaaactattttaaagatccatcacagggaagtgttgatgcacagacggcgattttagcggcagagagaattggtataccaagcggaacaaccatatattttgcagtggattttgactgttattcatatcagattgatacgtttatcataccttattttgagcagattcacatgatcttttttagttcgacaaatgacaaaaactataaagtcggcatttatgcaccaagatatgtatgtactaaagtttatgaagcaggattggcaagtaaatcatttgtggcagatatgtcaactggatttagctgtaatttgggatattcgatgccgaagaactgggcatttgatcaattttgtgagttgaactcattttcttcatcaccttcgttcccactggataaagatgcatattcagggagagatactggatttaaaaagttcgatgccgtatcgacaaaaacagatgaggaaatagcgcaagaaaatcttcgggcaaaggtaaaaatagcacgaaatcaatatgtctataatgtaatggagccgcttggttatctgaataaaattatggatgtgggtgtggagtatgataaggaaatttcactgggaacaatgatgagtcctcaaggagcaattgatatttctactaaaatatccacatcgcttgaaagttcaactggtaaaatttataatataaaagtggatataggaaatgatggagaattgacacaaacttgcaaaaatcaaattatggagatttcatcaaatttatcagatacaggtatagagggagcagataactttggaaatacgatagaaaaaattgctttatcggttaaatctggtaatattgcttttgaaataaataatgtttttgccaatagtgtagagttttccattgtatttagtacatcagatttgctgccagaagaggaaaaagagtggacaatatcggttgctttgatttttacaatgacattaaattctaatagtggtcttgaatttaatgttgtagaattcacaaaagagcatagtaatatactggcaggagccgtaatattagttcttgcgggtgcattagttgtaaatgcaattccgtcaattattgctttattttcagctggagcaggtactgtttttggtttgttgattcaagcgctgtaaattgtaaaagaataaaagagacaatggccagaggttcgattttataaagaggacctctggcaaaagggggattaagaagaatgcatattaaatcaattgtgtcagatgaggatagggaagaattagaaagaatgctttcgcttgggtttataattcctaatcaattatttaaaacaagacagaaaagtagaatgattatctatatttttacacctgtagaatttttactgtcgattaattgttatctgtcggaaagttatttgatgtttggaatagggattggaacttgtgtggcttgtgtggcttggattatttggtatcaaatgattggtaaaaattttgaaaaaaatgttcatgaatttgtctggggtagatcaggatatgaaacggtggatatcgatgaaaacgcaattaaaatagatgaagatcaaatttatgaatttaaaaatattgatagaatgttcttatataaaaacttcttttttttcataacaaatgaaaagaaaatatttatatttaaaacgacagatatggagtcggatgaacttataaaaattattaaaacaacagggattttatttgaaaaaaaagaaaaaccatttaatatttataagtattgtaaaaaaggaaaaagtttttaaaaataagcagaggatggtggatttatcatccttttagagaagagcatgtattttaaagggaatctggttttgcaggttccctttttgccatcaaaaacgttgatgttttatcaaatgacgctaaaaataaaaagaataatgcagggggtgacattattagttatcgctgtaatatttggataaaatataaataaaacataaaaaatataaataaattataaaatggcgacagttttttcttgttcaagtgtttattatatagaggacaaaataagacagcaaaggaagtggtgctgttgcatcggaaaaatgacacaaaattagtgatgtccattcgggaaaagaattgaaggggattcttttccccatttgtcgtgttacgaaagactgagggtaagaaaatatgctagaacttgcaatctgtgatgatgacatcatcctatgtaattggttagaacagaagctgctccattatgggaaagcgaatgactgtcagatatctatagaaatatactattctgcggagcagcttcttaacaggctggaagaagaatcctacgatatgttattccttgatatttgtctggaacatgagaatggaattgatatcggaacggagatacgaaagaaaaattatggaaaagaactgcggattacctatatttcaacatatcaggaatatgctatgaaattattccgtattcatccatttgattttcttgtaaagccaatccgagaggaagaacttttccgggtgataggtgaattacgggaactgttaaaagaacggaagaaaatatttgaatatacggatacaaaaggaatccacaagatttcttatgacaagatcctgtatttttatagtctgggaaaaagagtacatatcgtgacatcggaaaaagaatatgaatatcgaggaaaattaaaggatgtagcggatgtaacagaagaatatttcttactgattcacaagtcctatctcatcaatatggaacacgtggagcattacgaatatgacaacgtggttatgaaagacaagacacgtctcagtatcagtaaagcaaatcgcaagaaggtcagggaaagactattacaaacggagaagaaaagattatgaatatccatttgatcacttatctgacaagtaaattattctggatttatactgtgttccgttacaataccatcctgtatccaaaaaatgaggatacacaaaagctatttgcatatttttgtgcatatctgctttcatgctggggaagcatgcagtggggaacgatgtacggagatctgatctttgagctgatagctctgttaattataacagtggcatatcaggcagactggcaacatcatgtctggaatacacttatggtatatattatgggaattttatgtgatgggattccaatcgtgttctttcaacggtatgcggtagcaagaaatccggtgcatcatcacatgggaccgggaactattgtaatgggaaattttatattctttttactggaagtcattattgaaagaaaagtaggtgtaaagagaagttattatataaagaaccgtcattggcttgctatgctttctgtcccggtgatcagcattatagtctgtatcaggatattgctgccagacagaagaggtgtgcggtctacgattgtattattcttactgtttatcaatgtgtttattttctatctgcacgatgaggttcagaaaagttatattgaaacagcaaaacaggaagagatgaaaattcagatgagccagtatgcaaaagaactggagatgatgatgaaatcacaggacaggctgaataagatacatcatgattacaagcaccatcttacaacaataggggcaatggcaaaaacgggaggaaatgaagagattctatcgtatctgaaacaaatggagaatatagccggaacagccttatgtcatcatttatatacagaaaaccgtaatatgaataatctgctgaattatattttggaagattcgaaatcagtaattgaaaatccggagatttctgtagaaataccgaatcatataggggaagaattatttgatataagtataatagtgggaaatcttatggataatgctattcgtgggacagcagcttcagatgaaaggagattatcgtttcagatgtattatggaaaaggaatcatgaatatccagattgagaatagcataaaagatacaccaaaagtgcggaatggaatttatctgacaacgaaaagcaggaaagaaggacatggaataggattacaaaatgtgaaactcgtagtagaaaaatatcatggtcagatggagatctgccatacggagaaatcctttcaagtgaaaatattattatatatgaaattagatgaaaaatagtaaggcgatggtgtcttactatttttttcgaccgatttcgtctatttttgccacctcaaggggcatttttaccatttatgaaaattttgtgattttttagattatagtagtgccaaagtcagaaaaaaggagggtagcggttattttgtaaaggaattatagaaaaagattacaagagggagaaagagactatgaagagatttcgaaagtcggctatagccttagtacttgcactcctgatggcactacagggaacagagcctatttttgtacaggcaaaagaggccattgaggatgtacagaagaatgcagatttctccagaccagaggctttgacggaagaggaagcagggattacagattccacatctggagaacaagataagagtcagcagtctgatgcggacgtacaaaatgaaacgacgccatcagaagatacagagacgcaggaagaacagacaactccagcggaagaaacagaagaaaatccgcaggaaaaagaagtggagttgaaagaaccacaggattactatccgattccagaagaaccggaaggtgaactgattgattatgatgccatttccaagacttataagacaggggacaagcagtatacaaccgtttatggaggttatgtcggaacttataagaatgaggatggagataccgagctggttgataatacacttgtaaaaccagaagaagcagatactccggcatccgaagaagcacaggaagccagcagtgtagtggcaactgaagaaaaggaagagaaaacagaagtttatcagaacaaggcaaacgattatgctatccttcttccggaacagatgtcagaagagaatggtgtaacgattgaaaatggaaagaccagaatcgggatcattccggtagatggagattatacacattccgttattaaagacaatgcgatcctttataatgaagtttacgagggcgcagatgttcagtatacagtactggattccagcattaaggaagatatcgtacttcagcagccaacagacagggaagtctatgaatacgagctgcagattccggggtatcaggcagaagtaaaagacaatcaggtctatatctatccggaagggaagacaatcaaagatgcgaagtatcttctggagacgccatcaatggaagatgctgccggggaaatcagtttcctgatcacattggaacttcgggaagaagatggaaaaacaatcctgaccgtaaaaccagatagggattggctttcggcagaagaacgtcagtatccggtcaggatcgatccgacaccagtagagattcagaagagttcctttaacatgatcggtgtggaagagggaagtcctaccagtcagattggtgacaacaattatccgtatgtcggatttgatgatggtattaagtctgggaaccttgcaggatttggtactgcacaccagaactgccggacttatatcaaagtaaattcaaattttagtcagattccgaaagattccaaaattgacagtgcaacatttgcagtcagtcagaaaactgcatacagtggtggtgcatcccagtttggactttatcgtgtagatcagtcgtggaacacctccatcacatggaaaacaaaaccagtaaatcttacgtttcaggatgtacagaatgcaagtaccagcaggaacagctatatcaattatgacgtcaaagatctggtcaatgactgggtgcagggaactcatgcgaataacggatttgcactggtagccattgccgaggcaaataaccttggagcttctatgcagtgtgaggtactgaataacagggcatccgtttatggaccgaaactcagcatccagtggtcaccggctgaagatccatatctgcgagatatgtcactggatgaaacaacgatcctgcttcgcccgatgacagaaaagaatacaaatggaaagctgaagtttgatgccgtatttgcagacggaattgcaaagagcaaatctacagtagaatattatctgcttccagatgaggaaaatgaagaacatcacgaaacagatgcaaaaccattgtattcctatccagacagtactgaatacaataagcagttcccggaggcgaataagtattacagcaaagattccaactggcagagtgcactgtattcagggctgacgaaggacaagctttataagatcaaagcaaaagcatcgaaagagattgatggaaagctggaaacaggaaaagaagtgaccagtgacagctttgtgatctatgaagtgaagcagtttgatacattcccgaagattgcaaaatattatggtgttccgcttaagaacattatgaaagacaatcaggttatggacgcactggtagtcgcaaataacacgatctttatccgtaacccacagacaaatgttccatatagtcctgcaccgcttaccgatcaggataagatgcggattgacggagcattgatgggaagaggcctgcactgtgaatttggatttgaaccagtcaacttaaatactggtaacttctacatggatcagtccgatgcgacgatgaatgaactgaatggagaattctccattacaagaagctacaattccaaaggaacagaccagcattccatgttcggacgtggatggagctttaactatgaccagtcactttctcaaatggaggacggaagtcttctgtatatgagaggggacggaagttatctgatctttgataagaatgaagatggaagctacactactccggatggttatgtatatgatttaaaagcagtcagctataaagatacagaccatgactacatcggatgggaactgacagatgcggatcagagcgtctggtcatttgataaatatggagttttacgttatgtaacggatgtgaatggatttaagacagtattagattatgacgatgattataatctgagtaagattacaacaccatccggaaaaacattcggggtaaaacaggataaattcgggcatatcaaggaactgtctcttccagatggtggaaaagtttcttacaaatatgatgagcagggaaatctgatatctgtaacagatccgaatggaacaacaaaagagtacaaatatgatgatgacagccgtatgacaagctggaaagatgagaatggcaatacggttgtaaagaatacttacgataaagaaggaagagttgtagagcagactgatgcagaaaaaggaacggcaactttcaagtacggaaagagttctactacaacaacggataacgaaggaaataagaccgtttatcattatgatgatcagtaccgcacaacatccattgaatatccggatggaacaacctgtgaaaagacttataatgcagagaatcagcttgcttccgaaacgacagcagccggaacaaaaacttacacttatgatacatttggcaatgtagcaacggagacaagagaggatggaaagacagcctcttatacttataatgagcagaataagctgaccagtgcaactggatataacggagcaacggttacttacagttatgacggtaatggaaatatggtcacatctacaaaaccggatggaacagccattacctatacttacgatgacaaacatcgtatggtatcccagacagacggcagaggtgtcacaacaacgtattcgtatgacggaccgaacatgaccggatatgtggatggaaatggagcagcatggggattcacgtatgacgcgatgaatcgtgcagttaccatgacagatccacttggaaatgtaacctcgaacagttacgatgcgaatggcaatctgacttccaagacagcagccgatggcggtgtgaccgcttatacgctggatggtgtgggaaatattacagcaagtactgacgcactggggaataccaccacttatacttatgataagatgtacaacatgaccagtggtacagatccgaaaggaaatcagatcagctacgtttatgataagaattatcagcaggtcaaagcaaccgatgcaaaaggaaatacaattacttataagtatgacagcatgggacgtgtcatagaagagagtaataaagattttggaacaaagctctatgaatatgacaaagcaggaaatctgaaaaaatataccgatggaaatggaaatgcaaccgtatccaagtttgattctcttggacaggtgcttcagtccaaagatgcagttggtaatataaccaaatatgaatatgacgcattaggaaatgaaaccaagattacttatggagatggaagcagccattccaaggaatatgataactgcggaagactcgctaaagagacagatgaattaggtgcagttaccacttatacttatgatgcggcagacaatctggtatcaaaatcagatgacagtggaagaacctggacttatacctacgataatacaggaaaccgcttaagtgaaaccaacccagaaggtggaactaccacatatacttatgataaagcaggaaatctggtatcttctaccgatgaagagggaagaacagatacttatgcttacgacaaggcaggaaatctgactacatccaaagatgcccttggatataccgtatccatgaagtatgacttaaatggaaatctggtatcctctaccgatgaaaatggaaataccagtaccatgacttacgatggtaatggaaacatgacatcggtaagcgatgcaaagggcaacattacagcaatgaaatatgattccaccgacaatctggaacagacggtggatgccctgaaaggaaagaccacttacgaatacgattcacagggcaacagcacaaagatgacagatgccctcggcaatgcgtatagttatgtgtatgataaagagggaaataacacatccataatactgccgacaggggacaaggtgctgatggagtacgatgccatcggacagcttgtaaaatgtacggatgcacagggactcgtaattacctatcaatatgacggagcaggcaacctgatccattcctccgacaatggtggaaacagtatggattatacttatgatggtgccggaaatgtactgacacagaccgatgaacttggcaggacagcaacatacaagtacgatcagtacggcagactcctgaaacttactgaagcagacggaagtatcacatcttatgaatatgatgttatggaccgcattacagcggtaacggatgcggaaggtcataaaacaacctttacctacgataaagtcggcaaccagttatccatgacagaagaagaggaagccacatataaatacgcttacgataagaaagaccgggttatttctcagacaaatccactgggagcatccagcacctttaagtatgacggaaatgataatgtgacggaatctgtcgatgaaaacggtacggttaccaagtatgcttacgataaaaatgacaatctcgtatcccagacagacggaaatggaaatacgacaacctaccagtatgatgaactggaccgcaagatcggtgagacttctccgttaaaagaaacaaatgaataccgttatgatgccattggaaatcttaccaaatcaaaagatccgatgggactcattaccgaatacaaatatgacagcctgagtaacatgacggaacagatttctccaaagggagcagttaccaaatatgattacgacaagcatggcaatgtcatttctgtaacggatgcaaagggaaatgagacacagtacagtgttgacctgaatgacaatgtcacaaagatgacacaggcgaatggtggagagtatacctatagttatgataaagccggacgtctgaagagtatgaccagtccactgggttatactaaaaatttctcttatgataaagtggacaacgtggtaaaagaaagcgacagcttaaagagtaccactacttatacttacgataagctccataacatgaagtcttctaccaatgcactggatggaacaaccagcttttcttatgataagtatggcaatctggtgaaggagacagatccgcttggacggagcaatacctacagttatgacctggcaggtcagatgacttctgcagctgatccgcttggtaagataactgcttacacttacgacccggcaggaaatattactgaggtcaccaaaccgggtggaagaaagaccagctatggatatgataagaattataatgttacatctgtaacagatccgatgggctatgttgcaaagacagtctacgataaagacaaccgtgtaacagaagagaccgatgcactggggcagaaggaatcctatacctatgataaggacagcagggtaacttctattacagacaagcgtggattcacaacgggatttgattacgatgcacatgggaatattcaggttgttacagataagaccggattaaagagccatctggaatatgacaagaatgacaacctgaccaaagtaactgatgcccttggcggtgtaacaacttatggttacgacaacatggataacctggtgaccttcaccaatgcagcaaataagacaacgaattatacttatgacttagaaggcaacctgacatccatcaaagatccggcaggaagaacggagaaattcgactatgatgaaaaaggcagactgaccggacatacacaggcaagcggcaagaaaaccacgtatgattacgacaaactgaatgacctgttggagaaatcttatcaggacgcaaaaggcgagacatccgaaaaggacgtgacctacgcatataacagtgccggggaacgggtatccatgaaggatcagacaggcaagagcagctacgaatacgatgcacttggaagaatcaccaaagtgacaagcggttcgaaaaaggatgtcagctacgtttatgatgacgcagataatctgcaggcaatcgtatacccggatgggacaaagatcagctatgaatacgacttaaatgataatctggtaaaactgacagaccgtaatagaaaagtaaccacttacaagcatgatgcactgaaccgtgtgacagaagttactagaagtaatggaacaaagacggaagtatcttacgatgcagaagatcatatcacaaagattgtgaatacctgtggttcctgcggcaaagtaatcagtacttatgagtacaagtacaatgatcagggatatgtagttggagaaacagctacggaactggaagctggaacaagaaagacgccaagctgggaagactggtacaactggggcgatacacagaaagagacagacaaagcagactgtgagcatcaggaaaaagagatccagacgacacgtacctatgaatacgatgacaactgggaactgacacgctgtacggaaaaagcagagggcggtaaaaagacagtccataattatacgcatgacaagattggaaaccggacctcttacgagaagatcgaagatggtgtcagcaaagcaaaatataactacaagtataacgattccaaccagctcatcaaacgcacgaatgcaaaaatctggggcgatccgggaacaacctacagctatgataaagatggcaatctaatccaggaatgtgataagacaaacagtgcagatccggttacttatgaatacacagcagagaatcgtctggcagtcgtaaaacagggtggaacagtcctgatggcagccatgtacgatggagataacaatcgggtattcgaactggataacacttataaatgggaagactgctatggcgatgaagttctgattccggagaaccagcgtacagaagatggagacagtccgaaagaacagcttgcatctctggtaaaaggcggttccaatgccaaaggttacacattgacagagtatatcaacgatatcaatcgcgagaatacagaagtccttgcagagtatggagcagacgagaaagtacgtcaggcttatacttatggagaaagtggaatcggagaacgggtaagcgttgataaatcggaagaaagcagttattatttatatgacggaagaaacagtgtaaccggaatcctgacagaaaatgctaacctgacgaacagttatcagtacgatccgtatggaaaccttacatcaggaaccgcagatggagtcaattattacgcttacaatggggagtccacaaatgtaaaaacaggacttcagtatctgcgggcaagatactatgacgcagagaacggaacctttacaactgaagatagtgaccttggaacgacagaaaatccattaaccagaaatcgctatgactatacgaccaataatccgttgaattacagtgatccaacaggacattccttgtggagcaggattaagggtgcagctaagaaagcagcaaaaaaggttgtaaaaacagtcgtaaatacagcgaaaaaagttgttaaaacggttgcaaaaggcgtaaaagcggcagctaaatgggtgaaaaatgcagtatcccatccaaaacaggtaatacagaaagctaaaaataccgtaaaacaaaaagcaaaacaggcttctcagaagattgtatccagtggatcgaattttataagagctgtgagcaaaggtggagtaaaaggcggtcttagttacatcggaaatggtgctaagaaagtatatagttctttcaaatcctatgcatcagaaaaaacaaaagaaattcgccagacaattaaaagagaaatgtgtactacgacaaatagaatttcttcagcttttggaaaagttgattggaatgtcgtaaagaaagtagtagcaggtggagcaatcttagctggtcttggaattgcaacaatagtaacaggtggagcagcaggagtgattgcggccggagcattcagtggagctttgattggcggtggaactggagctgttcttggtggtttatctagtgctgcaaatggtgatggatttattcaaggtgcagctgatggattcttgtggggaacaattggtggagccgtatcaggtggtgttggagcagcaacaggttcacttgcaagttcatctgcatcgtcaatcatgaaaaatccattagctaagagtgcacttgaaaatgcggcagatacagcagttggaacaattgacgatttagcgcatggtagagatgtatctataggttccatagctatggattttggaactgggatggtatcatcgaatattgatttgaaaaaggcatctcataccacttcagttattgaagacacaacaaaacatagtgtcaaaccagattttattgtaggaacaaatgggactacggtatctaaagaagtatatgatatgtcaaatgcagaatttgttcaagaagttgcaaacatatcgaataaaaaagttaatgaggagttgacacaggaaggaaaatcagtatacggtcatgtggcaggttcaaaaaaacatagtgaagcctataggatagcaagtgattatcaagaatttgtagatgatcgaggtttgaagctggaacagccttataaagataatgaaagcaaaacaagaaatgaaaaagaaggcgtaaggctagacgtttacgatacaaatgatggacaagtatatgattataagtttgtaaagaatccggggaaaggactatcaaataggcaaaagaacaaaatcattcgcgaaggcccagatggattaacggaaaatgacattcatgaagtaaatccgaaataattaaacaggaagcaatatttgacgatattgcttccgctaaagagaaaaggggataaaagatggtaacaaaaaaacagataacaaatgattgggagcaactttttccagaattaaaaaagactcgattacttgaaatggataatagattgggtccattgataacaggaatctatctaaaagtaattagaaatacatattacacaccggttttttatgtacataatttatgcagagaatattctagcattacaacatcattagagtgtactagtgaaacaatagagttagaaaaacatgaagaacgttatatgttttcagcagaaaggttaaaaaataaattgttgattccacttaaaggcgatgtctcaatagataaaattatagaaggctataagttctttttaagtaatccaagaagaaaatcatttgaagaatataaagatattgctctggtttgtggatggtatggagaaaagaaaatacttgacgatatcctcgaatatatttggaataatgtgcaaaaggataaaaatcatcctttttttagaaataaagatagaggagtagaaggatggtttgaaaaaatttgcgaggactcaaatgattatgagagacttcatgaaatatgtgagagagaaatacaaaaacataaagtagaaaagttgccatatagaaacattatttaaactcaggtatataagaaaatgcaagtagaagaatgtgtaaaaaaattaaaaagcaaaggtattattgattccagagaaatatatatatatgcatcattaaaaaatataataggtggaatgtttggaagcataagaggattagttttgttatgcatatatgaggatgttttatatatttatcgagccaatattgataattcttatggcgaacgattagcgaaaatttatattccaaatatgaaaaatatccaagggaaagccggattatttggtggaaagttttctttcaattatgaagggcaagaatataaatttaaattgccatcaaaagctggaaaatttgtggattttttcgtaaagtaaaagtatgaggatagataccaaaatgaaaaaattacaaaaatatataatgattttggagacagtattgttatgtactggatttagtgcttgttcaaaacaaccagacttcgatgccaaatcctacgtccaaagttctcttgatgcatactatcatggagaatataaggactatgcgaatctgttagaaatctcggaaaaagatgccaagaaagaaatcgaagaggattttaatgagagcatccaacagcaatttgatgattccgataacattacagacaaaggaattgctgattatgcggaaaaactgacagaagtaaagaaactggcaaaatataaagtacaggatgtgaaagaagaggatggagtctatacagtaagtgtacaagttgaaccatccaatgtatttcagacattgcaacaaagctctacagaggtaagcaatgaaaaaataaagcagggactggatggaaatgatccggaagtctttgcagctgtattaacagaaagtgtccagaagagtcttgaaaagaacagttatgggaaagctgttactgtaaaagtatccgtggaaaaagataattcaggaaaatatggtctttcggatacagagatgagtaagctggaagcagcaatgtttccaacagaataagaaggaatggaaagctatcagaagaaaaaactggtagctttcttttaaactccaagacaagaaaatttgttaaaaaagctattgtaatagtagaaaaattataataagtaatggatgacaagagacttttattcattatgaggaaaagaaggaatctcctatgaaccaacaagaaatattcacataagagagaaaaaagtgctgtaatcgaagaggttgcagcatttttttctttgatatttttcaaacattataacgtacatatccggtcaccgccatgctccgatttgatctctatacgaaaaatcagatcggaggaaagataaatggcttataacaagacaagtgaagaacgaaagtggaattattggaaaaaacaggaagaaaagaaactgcgtgaactgggaatggaagaagagaagatccgaaagttgcgccagatggacagggaagattttctggaagagcgcagataccgggaacatctggatgaaatgatgcaggatatggattccataaaacaaagggacagaggacggtttgcacaggacatccgagaacttttagacaacattggagaccgacggatctatgaattattaaagggcacagaacatcagatattagagatacttttgcttagtacatggggatattcaggaagagagattgcccaaattatgggaatggcagaacagaccgtttataccaaaagaaaccgtttaagaaataaattaaaaaatttgttgaaaattgaataataacagcatttttcgtcggctatttaataggcaggtaaattttgccagtgtactttgacaatcctataccagcattacaggtacgttcccgtaagtagaagcgtgtcaggaaggcgcgaggacagatgaaaatgacaggaaagaatataaaaaaattctttgctggtgtttttgtttcgagcgaatcacctttaactgaaacaggaccgtggcggtcttttgcgaggatcacttacgaggggataatgatacataggaactgccagtgagcagaggatggactttgggttgtaatcagcaagacctttagaaaatccatgagcggtgcaatgccaagcatccgcctgtaatgttcccgtaaggcagtggggggagtcgaggacaaatacaacgccaaaaaacaaaagtataagaaatcaaggaagaatgtgtcgttgatatcagatacatgcggctgtagggagtaatcctttacagccgtattgatgtggtatcagcacgcatatcaggtaacaaattatgtattacacaaaagaatatttaaaaagagcacatcgtgaaattgatacaatctttcgtgtgctgttcccggaacatggaatggcagtaagggaagaacagattatgttatgccacgaaatgctggataacctgctgggaagaaacatagcactgtgtgacgcaggtgtcggtatcggcaagacgtatgcttatctggtggcctgtgttctgatgagaaaatattccctccttgcagaaggatgttccccttatgagcagcgtccggtcgtgatatccacttccagcattgcactccagaaagcaattcttacagaatatatcccttttctctcccggattcttcaggagaacgggacgattcaggcccccattaaagctgtgatacgaaaagggaaagagcattttgtctgcgatgagaggttggagcaacgaatcgttgcaatcgaagagaaaaacaaaaatgcgttgcagaaagaagctctgctgtcgttgaaagaacattatgatatggacgaagtgtccaacttaagtgggtttgacagaaggatggtgagtgtaccgaagttctgttcgggagactgcccgaaaagaggttcgtgcaggtatcagcagtatctggagcgttccagagataatgaaatgttcattcagatctgtaatcacaattatctgctggctgatggttatcacagactgcaggattaccgcccgttattgaaagattacagggcattgattgtagatgaagcacacaaactgccggatgcggcaaagcagatgttcgggaagagcctgtgttatgacgatatccgggaaatatgcttttatctagggaaagagtaccaaggaccggagataaggaaattgtccggcacgatccggatggtgctggacattataggagaaaaccacagaaccagatatgggataaaagaagaatttcacatgacagaagagtgtgcaatgtatttatatgaggggatacagaccatgaataagatcatagaaaaattagaaaagaagattccaaagtggatcagaaacaagctggaagaaaccagaagtgtgctggaatgctttttccatcaggataaaaagtatgtgctgcatctgaagcaggaccatgaccaccggattatattgtgtgcatccagcagacggattccgcagtacctggaccagatgttatggagcagaggtatgggagcgattcttacaagcggaactttaaaaaccggacagggattttcccacattcggaaaatgacaggattacagaggatgcggagagtccgggaatatgtggcagactccccgtttgaatatcagaagaactgtctgttatatctgcccaagaatttgaaaaaatacagaagaggaagtcaggaagaggcagagatgatagcaggtcatattcattcgctgatctgttcgacttacggacatacgctggtgctgttcacatcttatcatttgatgggaaacatttaccagatgttaagggatgaaattccattcccgatgatagaggtgtggagacattccccggaagagatcacaagatttaaacagatggacaatgctgtcctttttgcagctggctcctgctgggaaggagtagacttccccggagatatggtatcttcgctgatcattgtaagactgcccttcgctgttccagatcccatcagcgaagcacagaagaaggaatatgccggtctgaaagattatattcaggcagtgattgttccagacatgcagaaaaaactaagacagggattcggacgggcgctccgcaccgagacagatacttgtgtcgtgtccattttagacgagcgtgcaggagaaggcggcaggtatcatgaggaagtgatgtgtgcgcttccaagctgcaagatggcaaaagacatcaaggatatccagcactttatccgaaaccggaaaggcgtggaatactacctgtaaccgttcgtggttctgctacaggaaaagcagattttgcacgaaaagtttggtggtatttcaagggcgttttcggtgggattgttggtattgatgaatagctatttcggcatgaagtgggtatactgtgtatagcgttagaggaaaggaggcagcttatgatatacaaggtggaaacgataaaagatggaacagaaaaatattttttcatcagaaatctggaaacaatgagtattgaagaactgccaagtaaatatctaatgcataagattaaatgtaaacgttcaccaaatacagtgaaacgcacagcattttcaatctgctattatatgaaatatatggcagagaaagaaatggaactcacagaagtctatcagttagattatgaaaaacagacagaacactttgtggaatttttatactggcttaaagccggaaaccatacagagcaaacggctggagaaaagaagtgtccgaatgaaggaacctgcaacgcatacttaaaagatgtgttcaggttctatttatttatagaggcagaatatgaacagtacggaagtctcaaaaccttatcgtataaccagattatagcggttaatcaggtgggagtaaaaaaggtactgcggaatcattcttttaaagcctatctgaaggaagaggaacatcgtgggagaacagcaaaagaaaatcagattattacaattttacaggcctgtacgaaccgaagagatcagcttctgttacttatgttagcagaaaccggatacagaattggggaactactgggagtaaaatatgtcaaagatattgattataggaatcacatgataagggtatgcttccgggaagataatgaaaatgaagcgagagccaaaaatgcggaatacagaagtgccaagataagtaatgatacgtttgaatttctcatggattatctggcaaaatatcggaaaatcctgcaacatcaggattacctgtttgtgaatatcatgggtgagaacattggaaagccattaagagtggacagtgtatatgatatgttggaccgaatggaaaagaaaaccggagttaaaatcacaccccacatgttacgtcactattttgcaaatatgcgaaagcaggcaggatgggaactggaaatgatcagtcaggcattggggcataaacatttggatacgactataaagtatctggactggctggatgatgaactgatagaagcaagtaatgagttttatgcacaacacactgctatttatggggcggaacgtctgctggagtagggaggtgtgagaaatacctatatatttattgcaacaggcagaacacataacagaatctgaagtagatattgagaagaaaaagcaggaactatattcagaaattgatgcacttggaataaaaagcgattcaagaattaacaaattgaaaaagttcttggcagatagaaaaatctggcatctggaagaaatggattatcctttgcgaaattcgtatgaacaatatttaagaggacagatacgatcacaaattgtatctttctatttgaaaatatatgatacggtaaaacaacaacatatctatcaacagatgcagacgctaaatggaaagcggatatatgaatggaaatatcaaaataaaatttattttctgaagtattatccggaaaaggaaatagctgagacctttgaaacttcttataaaacaaacctattggtgtgggattttacacaaaattgttcagaagttttaaagaaacaaattttttatacgttgagtcgtatcattgcaaatacttcaatgtctaaggcttatagaaatgtcaggttaaaatccttaaaacttctttatgattcttgtgttcagttaaatattacggatattggattgctggaaatggaacaagtggaaactattttaaagaattttcccgaaacgagtcaacgaagtattttaggtgaatgcagaagagatgcgtttatgcagcaggaacagatccaatgggaagcaaatgtatggtatctggaacgattacatcttggaaaacatcggatagacgaaagtaaatccttaattagcatttcttttatggaaatcaaggaaatacagaatcgagaaattttacaggcatacatgaaatatgaactgggaattactggacaggcagtcagcacgattgtacgaagatttgtatgtattagaaattttattgaactgctggaacaagaaaagatactggcgattcatgcaactgtcgcagaagtaaaaaagtatgcagacggcttgcgagaacggggaatgcaggcaaagggatttaatgaaagaattttcggtatcggtcatttttataaattcatggaagttaaacagtatattacaagaatgccattccgaattgaatatttccaacaaaaagaagtagtagtacatcatgatcgtagcgttgaggaaacagtatatatggaaattttgaaaaaattatatctttttccagagcgattacgatgtatgttcctacatctgtggtgtctaggattacgggcgagtgaagtgtgtacattgaaaggaaatgcttattatcagcagggcgaggattattggattcaggtgtatcaggtcaaaatgaagaattataaaaggattccaatcccacaggcactttatcagattatgaaagtatacttgaaaaaacatgaaattcagcctgaagaattcatttttaaaaacaacagaggtggtgcttgtctatatggcacattccgaactcagatgatagaagcgtgccgggaaaataagattgcaaatggagaatatttatttcaatcacacgattatcgacatacagtagcaactatgttttatgacagtcatgtatcactgcaaagtatcagggattatcttggacatacttatgaagagatgacaagacagtatattgattatatgccacaaaggattgcaaaagcaaatgatgagttctttgaaatgcaaggaagtagtttagcatcatggctaaagaaagaggaaaaagatggaaaatgatattatatacttcagcgatttccccaatttacaagaaacagggacacgtaaggataatggaaaatttgatttaacgttgcttccaacgcaagaattaaaggaagagtttcgaggttatattatgtatcgctgcaaaaacggaacgtttagagcattgattcaggatcgaacagcttataatcatattgcaaagtttttgaacagcagaataaatcggagaatcaaaagccttggagatagaaatccagaaaaatggatatcacttttaaaaggctggatgttagaacagggaataactattgtaaaagaaaagaagagtgtgtatggtacagtaagctatggcgaagcagtgacgatattatatttcagaaacgtactgaaatttttagagccagaagatttacgggatgagatagaaaaagatgtttgggaactaaaaaatctggatattaaaatcagatccaatccaatttataatgtaaaaacactggatttcagaaaaatatatcagccagatatccgggaagaatgtaagaaagctgtttatatgaatctacagtatgaagcaataggaactgtacagggagaactgacaataatgaggatattctcagaatatctccaaaaagagtattccaaaataaaaagttgcagtgaaatagacagagaagtgctggaagaatttttgatacatctgtcaacaaaagatacttcccatagtgcgaatagttcttatgtaatttcattaagacgacagttagagacaatcggaaaaatttacagctatgaaagattggagcatttatttattaatacggatattccaccggaagtaaatgcagaatttagagtgtattctgatgatgaaatgaaacgactgaatgcggaaattacacagatggatgtacagattgcaagatgtcttctgatacatcagatgcttggaactaggatatcagatacccttacactgagaccagattgtctgacgagagaaaatggccaagatatgattgaaatatatcaagttaaaactaaaagatataaaaaaccgatcagtaaagaacttgcaaaactgttacagagttctattgaatatacacaggaaaagttcggtgatacagaatacatatttgttaatgaaaaagaacctgaccgcccgatgcagtatatggctataaaaacaaaagtcatgtccatgatacaggaaaagcagttgaaagatgatcatggcgaattattcgggtttggaacgcacatgttccggcactactatggcgtcaaacttacagaaatgcatctggatgactggacgatagcgagactattggggcataaaagactgaataatgtacagcattaccggaaaatgagcaatcaaagaatggcagacgaaaccagagaagtaagacagatgatgagtgacatcatatatatgagtctggcaggatggggtgaagaatatgagcaaatacgacaagatgattgaggaaaatcagagaaaaagtaaagagaaaattgaactggcattgcaagcaatacaagatatgctggcaaataaagaacgtatcagtgttccaaagctgatgaagaaaaccggattgtcgagaggattcttttataaaaatccaaccgtccgagatacattgaaccaagcagtagagcaacaggccggaatgatagatccaagaagagaaattctgaacatggcgatggaaaaacagattgaactgctgaaccagaaggtagcagctctaaccagagaaaataaggaactgaagagaaagaacgaaaagttacagaaggcattatggaaacaggatttgaattttattaagaacttataacattgaaaataatgagatggaagagatgtgtgtagacacatcttttcatcgttgaggataaaacatatagaatgagaatgggattgttttatggtatactaaaagtgaaatgctaactttgatatgaggtataaaacaatatgacagaaatacaaattaaaaatttaattaaagaatatgaaaaagaatatattgagtttatggaaattgagaaattaccacagtataagatagatttttttgaaattaatgttgaggaaagcgatgcagcaggattcgcttcagccgcccaagcttactataatacgaaaacagatgaacatatattaaggatatgcaaaagttcggaaataccaaggtatattgtgtttcatgaatttacgcatattttagatacggaaatgtatgcaaagcaagattcttggaaatatatggctttgtctggttatacagaatatcatgcagcacaagttgaattgatgataatgttaggagcagatagtatacaaactcaagatttttcatttacagttgatgttgaaataggtaatagtacagttaggaattacctaaactcaagacatcaattagtagtgaatatgatgaatagaacagattttccaagagatattgaagcattaaaaacaacggtaggtgtgctatataattattttggagtgcgttctatatgtaaaatgtatacgaaagattatactgaagaagtggataacacaattattattcagaaactttcaaaagtattatttgaagagataaatagctttatggttggatggtttaatgaagcacaagtagagctgagctttgtgtcatatatgaaaataatgtggcctatgcttcaaagctattttggaaaagaatgaaagatagtaacagtaaacacagttttgtatacagttaaacccagtaaaatcaacgcatgaggggaactggctacattttactatccgatctggtggtatgtggctccgacaatcatcaatacatttttagaagcttatgatttcagtggtaaaaagattgtgctttttgcaacatccggaggaagtggatttgggaacactgtgaaagaattgcagtcatctgcaccagacgcaattattacagaaggcagactgttaaatcgtggaacaaaacaggaaatctgtgaatgggtaaactctttataaataacagcgttatggaggtatatagaatatgggaaaaatagtacagacagcaggaagaaatacacttggtgaattcgcaccggaatttgcacattttaacgatgatgtacttttcggcgaaaactggaataaccaggatatcgacgtaaaaacaagaagtattatcacagtggttgcgctgatggcttccggaattacggattcttctttaaaatatcatcttcaaaatgcaaaaaatcatggtgtgacacaaaaagagattgctgctgtgatcacacatgttgcattctatgcaggatggccaaaagcatgggctgttttcaatcttgcaaaggaagtgtgggaagcaggcgaaagagatttgccatacgaagaggaagcgatgcgtgcgcatgctaaagagatggcatttccaatcggtgcaccaaacgatggctttgcacagtatttttccggcagaagttttcttgcaccgatctctacttctcaggttggaattttcaatgtgacatttgaaccaggatgcagaaataactggcatatccatcatgcaaaaagtggaggcggacagatcctggtatgtgttgccggaagaggatattatcaggaggaaggcaaagacgctgtagaaatgaagccaggtgactgcatcaatattcctacaggtgttaagcactggcatggagccgcaccggatgaatggttttcacatctggcaatagaagtgccgggcgaaaatagttccaatgaatggcttgaaccggtaagtgatgaagaatatagaaaactaaaataggaaggttgaaaaaagtatatttataagacaatttgcatatggaggttatatttatgttgaaaacagaagaattaaaactagtatctgaatgggataaaacttttccaaaaagtgaaaaagtagatcatgagaaagtgacatttgcaaatcgttatggaatcacacttgctgcagatttgtataagccgaaaaatgcatctgggaaatatccagcgattgctgtaagtggaccatttggtgcagtcaaagaacagtgttccggactgtatgcgcagacgatggctgaaaaaggataccttactattgcatttgatccttcttttacgggagaaagtggaggcaatccaagatacatggcttctccggatattaatacagaagatttcatggctgctgttgatttcctttctgttcgggaagaggtagatcaagatagaataggaatcattggaatctgtggctggggtggaatggctcttaacgcagctgcactcgatacaagaataaaagcaacggttgcatctaccatgtatgatatgacaagggtaaatgcgaatgggtactttgattctgaggacagtgaagaagcacgttatgcgaagaagcagtcgctgaataccctcagaacacaagaatactgtaaaggcgaatattccagagctggtggttgtgtttctcttccggttccagaggatgcccctttctttgtaaaagattacagtgagtattataaaggcagatgttatcataaaagaagcctgaattccaatgatggctggaacagtattggatgtatgtcatttatgaatcagccaatattaaagtacagtaatgaaatcagaagtgcagtcctcattgttcacggagaaaaagcacacagctattattttggaaaagatgcttatgaaaatatgattaaggacagcaagtacacatccaataaagagctgctaacaattccaggggctgttcatacagatctttacgataatctggatgtaatcccatttgataaaatccagaaattttttgaagaaaatggagttggttaattatggtaaaaaaagtattgatcatatcgacaagtcttcgaggagggagcaattctgatatacttgcaaatgagtgtgcaaagggagcaaaagaagcggggcatgatgtggaacttctttctttgaaaggaaaagatataaaatattgtatcggttgtctagcctgccagaggactgggatgtgtgtacagaaggatgatattgcagatattatggcaaaggtaaagaatgcagaagttattgtctatgcaaccccaatttattattatgagatgtgcggtcagatgaaaacacttcttgatagattgaatcctttatattcggcagattatttattcagagatatttatatgattgcaactgcggcagagaatgaggaaagtgcatttgagaaagcctataatgggctgcaaggctgggtagattgttttgaaaaggcttccttaagaggcatggtcggtggcggtggaattgatgcagcaaatacagctgaggatcatgtggatataatgaagaaggcatatgaacttggaaaaaatttataagttgataaaataattctaattattaaaactaatagtaactcaatattatcaatagcaaagctataagttttcaaaaaatggagtcttatagctatttttttgcgcaaaaataaaaaaatttctccaacaccctgtaaaaacaccgttcttcttttgtatatgtgagagataaaaacaaaaaaataaaattttttgtttttgcccactgtattttaccctctgagcgtttcgttatatgagggcgtaaaaaagaaagtctgatgcagtggtaataaattgtttttgtgctctcaattgaatccaggcctgattcatatggaacaagtaaatcagaacaaaaaaaggaggaagatgcgatgaacaaagtgattttaatgggacggcttataaaagctccggagatcaaatatttgcaggatgataacaaaactgcaatggcgcgatatacgttagcggttgaccggaggtatggaaaagactgggaaagggaagcagattttattccctgcgtgacattcggaaagaatgcagagtttgcagaactctatttgaaaaaaggaaccaagatcgtcatcagcggacgaatccgcacaggaagttatacggacagcgaaggagtgaaaagatatagcagcaatgttgttgtagaagaacatttttttgctgaaagcaagaaagcatccgatacggatccaaaggatgagaaagatggatttatgagtgtgccggaagaagcagagttgccgtttgagtagacagatctctggagcttaagcggaaaagcgcacttatatactttagcaagtatgtgcgtcctccggaaggatacttctttctgaaagctattccaaaagaagttttcggattgcatccgatgaaggggtatcccttccggcatagatgcctaacccataaaaagaaaacatgaaaatagaaataaaaggaggaagttgattatggcaaaaaaagaaaattttcaggaatatgtagtacgtacacaaaatgaaatcgcagggactggatttttaaagatcagcagaggcgtgaacgtctggtaaaggtgtacaatgaacgatttaacagcatccgtccccgtgaatacgatggcagtcatttgacttttccaggaatgaatccggaaatagaacttcgcccacatcagaaaaacgctgccgcacaccagctttatggtgacaatgtacttctggcacacgtagtaggagctgggaatacctatgaaatggtagcggcggcaatggaaagtaaaagactgggattatcacagaagaatctctttgtcgtgccaaaccatttgacggagcagtggggagctgagttcctgcagctatatccgggtgccaatattctggttgcaaccaagaaagattttgaaccagcaaaccgaaaaaaattctgtgctagaattgctatgggcaactatgatgctattatcatcggtcattcccagtttgagcgtatcccaatctctgatgagcggcaggaagatatgctgcggaagcagattgatgatctggaaatggcaatccagagtgcaaggtatgaacaggacggtggacgttatactgtcaaacagattgaaaagaccagaaaaacactgcagacaagactggaaaaactgaatcagaaagagaaaaaagatcaggtagttacgtttgaagaactgggcgtggatcatttgtatgtagatgaagcacacagctataaaaatgcgtttctctacacaaaaatgagaaatgtagccgggattgcacagaacgaagcacagaagtcagcagatatgttcaataaatgtcagtatctggatgagattacctgagggaaaggcattacctttgctacaggcacaccaatcagcaacagcatgacggaattatatgttatgcagcggtatctgcagaacagcaaactgcagaatatgggacttggattgtttgattcctgggcttccacttttggagaagttgtcacgagcatcgaacttgcaccggagggctatgctttaataggacgataaagttaactgtcctaaattgaaaatacataaggaaggaggttaagagaatgtcaaggacttcaaagattacagcactttatgagagattatcaagagatgatgacctgaatggcgagagtaattccattaccaatcagaaaaaatacctcgaagattatgcccgtaggaatggttttgagaatatccgccattttactgacgatggtttttcgggtgtaaatttcaatcgccccggctttcaagcgttgattaaggaaattgaagcaggcaatgtcggaacattctaagcagacgcttgttgttgaccctgtggcttctgaggtggtaaagcgtatctttctgcttgcaaatgagggcaaaagtccacgagccatagcggaaatactgaccgaagaaaaggttttaattcctgccgcatatgcaaaggaatatcacccagaacagtacaatgggattaagtttgcagacccttatatttggggcatatctgccattagaacgattttaagcagacaagaatatcttggacatactgttttgagaaagtcggtcagcaccaattttaaattgcataagagaaagactaccgatgaagatgagcagtatgtgttttataacacccacgagcctatcatatcgcaggaactttgggacagcgttcagaagcgaaagaaacgagtgaacagagctgcggcaagaggtacacataccaaccgattaagcggttatctgtactgtgccgactgtggcagaagattgaccttgcagacacattacagcaaaaaagaccgctccttgcagtattcgtaccgttgcggtggttatgcgagcagggtaaattcctgtactgctcattcaataagtgctgataatgttgaagccttgatattatcggcagttaaacgcttttcaaaattcgttctgaatgacgaaaaagcctttgctttggaactgcaatccctttggaaagacaagcaggaggaaaagccgaagcacaatcaatcggagttgaaacgctgtcagaaacgctatgacgaactctctacgctcattcgtggcttgtatgaaaatcttatatcgggattgttacccgaaagacaatacaagcaactgatgaatcagtatgacgatgaacaggctgaattggaagcgaaaatagaaacgatgaaaaaggaactttccgaagaaaaagacagcactatggatattcagcattttgtttcgctgatacgcaaatataaaaatcctacggaagtttccgatttgatgtttaccgaactcattgacaagattgtggtgtatgaatacgagggtgtaggtaaagcaagaacgcaaaaggttgacatttatttcaattatgtcggacaagtcgatattgcctacaccgaggaaaaacttgccgagataaaagagcaggaagaacaggaagaaaagaagcgattggagaaacagcgtcagcgtgaaaaagcctatcgagagaagcgaaaggcgaaaaaacttgctgaaaacggtggcgaaatcgtcaaaacaaaggtatgtcctcattgccagacagagtttgtccctacaagcaatcgacaggtattctgttcaaaggattgttgttatcaggcaaggcaggataagacgaaagccgacagagaagcggaaaaaggcgatcactattaccgtcagcgtgtatgtgctgtgtgtggtagtacctactggcctacacacagtcagcagaaattctgctccgaggaatgtaaaaaggtaaaccacaacaagaaaaccttggatttttaccacaagaagcaaaaggaggaagcactatgcaaagatttattacagacgaaagagcaggtatccgatacgaactcatcggagattactattatccctgcctgacagtagaggaaagtcctcccctttcaaaatatggacggttgcggcaacgatatttgggggaacataagcgtgtgctatattttaatctgctgacaagcagaaagttatatgaacaccttgccgaaattgatacttcggctcgtgatatggcggaatatctgataaaggaaatggcaaagaagcagggtgtaacggaagaactgaaagcaacggatatgatgagatggataggattgatgaataacattcgagcctgtgccgatgagattgtattgaatgatattgtgtattcctaacggataccaaccgaagaagaactgctgtcaaaccaatggcagtttttctttttcggcaagtattcaagaagtcattaagtcgtgagtataatcgaagtggtagaaaagttacctattatatcggttgtaacttttttatgaactctattgacaagaaaacttggcatgtgtataattaaaatatgcaaagaaaacttggtatggaggtgttttgatgaaaaaggacgaaatcttaaatgcaagcagaaaagaacatcgcaataaggacttggctgaaatggaagtggtatatcaatccggaagtcacgcaagcagagttggtgctttagtgtgttgtttgctttcgctgttatcttctgtgcttgctcatactatgatttacagtccgtgggttatatacttcagcattattgcaacacaatggttagttcgttttatcaaaatgaagcgaaagagtgatttggtcttgaccgttctgttttttgtgttttccattttggcatttgttggatttgttagccaccttttagaggtgagaatatgaaagaacaattacaactgaaaaatcacttaaaggaagttcgcacagaagcaaatctttctcaagctcagcttgcagaaatggtaggagtatcaagaaataccattagttctattgaaacaggacagtttaatccaactgcaaaattggctctaattctttgtattgcattggacaaaaaatttgaggaactattctatttttaggaggtcattatggaaaatattataatgttgattttgggagtgttcatatctgttgtgggaattgtaaatatcaaaggcaatatcagcacaattcactcttataacaggcgaaaagtaaaggaagaagatataccaaagtatggaaaaacagtcggcacaggaacgctgattataggaatatctcttgtattaggttttattgtttcgttttggagtgaaataattatagattatatcattcttccagcagttattgtcggattaggctttatattgtatggacagttcaaatacaataaaggaattttttgagaatcagggaggtataaagatggaattgaacacaatatcaggtctggcgatagcgggagttatctgctccgttgtcctctcgatgggggtaccgattgctttgttcattgcaggaagggtgaagcttaaggcaaggatttcctcgttctttatcggagcaggaacctatctgctgtttgccatgctgttggagcagctgctgcatgttcttgtcattcagttctgcggactgaacgcacagagcaggccatggctttactatgtgtacgcggctttggctgcagcggtttttgaagagaccggaagactgattgccatgaagttctggatgaagaaatggctggattttccaaatgcactgatgtatggaatcgggcatggcggtgtggaggccattctgctcggaggactctccggaatcagcaatcttgtgtccatgctgatgatcaacagcggagccatgcagaatacgctggcggcacttcctgctgagtctgcaaaccagaccgtgtcacagctgtcggccctatggacaacaccggcaccactcttttttgtaagcggaatcgaaagaatcagtgccatcattctgcatatcgggttgtcactgctgatctaccgggcggtaaaggcaggcaaatgcaggacagcggcttttacagcggttcttgcatatgggattcattttatcgtggacttctttgccgtggcaggtccggcgcttcttcccatctatgtgattgaaattggtgtctttgtgatggcagccggaactcttgttatggcgctgaagatgggaaggatggaagaactgtgaattccagttttctgctatcataaaacagaatatatctgacagaacgcaccgtagaaatacggtgttttttgttaccccaaacccacaatttcatacacaaccacaggttagtacaaataccttatgtgcgtttttgaaaggcttagaaagggatatttaccccgattttcgccccgagaaatgacacaaataaggctgaatgtatcttctctgtggtttttatattttcggcaggaaaggaggattgcttgctatgccgagaatgagcaagaagcggaaacaagagtgggcgttgtttctgaatgatcgaaaccgcattacctacaacgaactttgcagaaaatgcaggaatgactgtaagcagagtttccgctgtattgtggtgctttgcccgaaatatttatcgaaaaggagaacaaagaaaaatgattgaaaatgaaatgactgtcagcgtgcctcttgaagttgtcaaggcgagtgaaatcgagccgaaagaagtgaaatggctatggtatccatatattccggttggcaaggttacgctgttgcagggcgatcccggcgatggaaaaagcaagctaatgctttccattgccgccctgctctcaaagggcgaacctctgccctttaccgaaacggaagaaaacgagcctatgactatcatctatcagacaacggaagatgacgccgatgatacggtagtccctcgcttcaattcggctggtgggaacggagaaaacctcatcttcatcaaggaagatgaaaaatctttgtcctttggggataaccgtattcgtgaagcgattgagatgtaccacgcaaaacttttaattcttgacccgatgagttcctatatcggagaaagttgttcgatgaacaatgccaacgaaacacgagccgagtttaatcatctgatagcggttgcgaaagatacaggctgtgcgattgtgattattgctcatatgaacaagatgagagataccaatcccctttaccgtactaacggttcgattgacattgcgggtgctgcaagaagtattcttgcaatcacacgcacaccgaacaaggaagtacctgcggaaagatatttggtgcaggtaaaatccaaccttgccccgacaggctctgccattctgtttgaagtatctgagaaaggtgtggactttatttccgaaatggaaatgacagcggaagaagcgttccaatccctcgccccgaaaatcggcagacccaacgataaggaagtcaaggcgaaagcatttctgattgaaatgctgaaagacggagaaatgctttcttcgaattgtgaagaaaaacttgaagccgcagggttcaggaaatcgaccattaaaaaggcaaagaagaacgcaggagttatctcccgaaagaaaggttttctgtggtactggtctttgccgatgagcgatataccgagagaataaatgtaggctgtctgctgatgggacagtctgtttttatgattgaggtatcaaaggaggtcaagggggaacacccttgcccacgacatctttgcagacgaagtctgaaagtgtcatagtgggttacacacattcaaagaatgttgtgtaatggcttcgccctgccgagaaaggagaacaaaaatggcgaaaaacaacaaggcggatatgagttgtgcaagggttaaaaagtacaccgcttctgatgtgagcaaggcagaaagacacaacgaacgcaagaatgaaacctatgaaaatatgaaagtgattgaggaacgcataccttataatgtgcatttcaaaaagccttttactccgacctatatggagcaattaaagcagatggaagctgacggtatggtgtcgcttcgtggattgagaaaagacgcaacgctctttaacgagattgtgattgatgtgaacacgatgtacttcgagcgtaacggtggctacgaatatgcaaagcagttttatgaggaagcgttccatttcattgaggaaaaattcggtgctgaaaatgtaatatcggcagtaatgcacgatgatgaaatcaatatagcggcaaccgaggaacttgggaaaaaggtgtaccactatcatcttcatgctatggttctgcctgtggtggagaaagaaatcctatggagcaagcgttgcaaagatgaaaaactgcgaggaacggttaaggaagtagtcaatcagattagccattcaaagaaatggaaatcggatattccgctgaccgatgaaaaaggaaatccacttcttagaaaaaatgggaaaccgatgttccgagcttcatacagcatactgcaagacgaattgtttaattatatgacggagcgaggattcaaaggctttcagcgtggcgaatatggaagtaccgccgaacatcttacttccctacaatatcaaatcaagcaggacaaggaacgattggagaagttgcagaagcgtattcagcgtgaacagatgaagtatgagcctgcccgtaatgtttccaaaacctataacgagattgacagtatggggcagaaaacaatcacgggtaaaatggcaatctccaaagaggattattctcaactgactgcccttgccaaagagggcattaccagtcgtgcagaaatcagcgaattagaacagaatgcaaactattaccgacagaaatattttgactgtgcaaacgcactcgaaagaatgaaaactaaatacaacgaactgaaagaaaagtgcggaccttttcttcaagcgttggagcatttccccgaagttgctaaactttttaccgaaaaagtgaagcaacttttttcttttaaggaagcgcaggaacgagccgaaaaagaagcaagggaaaaagaacgacaggagcgtatcaaggctcgcaggagtaagcgtggtatggaaagataaccttttccattatactcacgacttaataacttcttgaactattgaaaatctgcggttattgggtgttccaatatgaatgccccacaatcaaatcttatgaaagagaggagcggactatatgaaagaacagaaacattcttattcgcaacgcataggaaaaacaacattcatcgtaaatgtaaagcagtccgaaagtgccaaaaagcctttgaatacggtgtttcaagacatctgcaagcacgaggttttgggcgatttctttacggacaaatcatttaatttagaaaatccacaaaaagtatcttgacaaactcgaccccgaaggaacaggatatcgagcaaaatcaagattcgccagattctataatatcccggaactgatgaatatgtttaagaaaattgctgatattaagacttccgatcaattaaaactccctgtgccggaagcagaatatgaaactgtagtattgaagccaaccgatcagcagaaagagattgtagaaagtcttggtgaacgtgcagaagtagtaaggaatggcggtgtggatgcaagtgtggataacatgctgagaattaccaatgatggtagaaaacttgcattagatcagcgactggtcaatgatttactgccggatgatccaggaagtaaagtatctatttgtgcagaaaagagttatgaaatttggaaagacacagcagcacagaaatcagcacagttgattttctgtgatttgagcacaccgaaaggcgatggcagtttcaatgtttatgatgacttgaagaagaaactgatggagaaaggtgtacctgaaaaagagattgcttttattcatgatgcaaatacagaaggtatcattgaccaggaagaagcattgaaattatacgatgtcggagcagatatctatctgaacactaatttttcgtcaccaatctatgtcacggaacgcatggaaatcgaacgaggaccggagcattatcagatgtccatggcagaacgggagcgtttccgtaacctggaatgggaaatgcagaaatatccacagattcagtctttgaaagaggcaaacttgttgttaggaacaaggcgaacctttggtatttatcagatcaaggacgattcaccgggcgaaaactatgcatttatgaatatgagttttattgaaagtcatggtatgcagataaaaaaagaagattataagctggtctatgttggcgaattactgggaaatatgtcactggatgatatttttgaaagatttaatattgatagaccgaaagatttccgtgggcattccctgtcagtcagtgatatcgtagttctgaatgatggggaaaaagtaacagctcattttgtagacagtatcagttttgaacagctagattctttcctgaatctggaagaacaggttcttagtgaactggcatatgaggtaggagaacgttactttgctattcagagaacagaagaaggatatgattattccttttacgatgaagatttccgcctgatggatagtggcgtctatgaaaatgatgaaatttctattgaagaagcggcagaggaacttctggaagacgaaggctggactggagaacgcatccgtggggattatgatcagttgatggaaaaagtggaagaaatggatgaggttgtaatggcagagattcagaaaagccagggcgaatataagcctttggcaaaggtggaggaactggaagaggcgaattataacatgattgataacgtcctcaacaatatgccaccgaagaaagagccttatctggaatactttgccacagaatgcgatgagttccatgacatgggagcttatgaaaaaagtacagatgttaatcagatagctgcagtctataaaaaatatagggagaatccagaaactgcgtatctgggatgctcgatgggaattatctatcgtgatccggaagaccgttactacgatgatgctgaatttgcaatcgtaaaaggaaatacagtacttggaaatctgatggatgatgttcggttttatggagaacttgcactggtacgggaagggattgagaaaattcatgaagcattgccggactataagtatgtaccgatgagggatgttcgagaagcaatgtatccagagaagatgaccacagaacagttggcagaggcaatggatgagattgcagaagcttttgatccgtatgagtatcgggataatgttgagatgggagaaaatacggtacaggaagtaatgttggatttacaaagcggtaatattcattattatgtttcttacttgaaggatattgtagacgaagaatgcgaccagtctgtgcgtgcaggtgtattgatggaaagactgaaagcttatgaaccggaacttcccaaaggtatggaaccaatggtgtatgtaaacttctgtgaagagagtaatttcatgaatccaagatgtcagaagttatccgagttggatgcaaaaacagcagaaatggataaagaatggtatacaaaacgtgatccgaagacagaggaacctacaaaaatcgcaaagatatatgtgacggtatattatgcggaaaaaggcgaacagatgctgcatcatttcaagaaatcaatggatattggaaatggacatggcggtattgtgagtcagttaaagtatgataatgaaatgaagcttacagatgagtattggatcaattaccagaaaggcaaaggaagtgaagagttccaaaagtatatgtaagatctgatggatatgcagaatcatgtactgccgtatttgcagagcttttgcagtctggaagaaaaaggtgtgaaggagagacgagaacagcaggtggcagagaaaaatgagagcagagaagctgtgccgagagctggtgttgaaataaatacagcagttaaggacgcagggaaagctgaaagaaaggcagtagcacagaaaaagacaatgccagaaaaagaaaagaaaccgtcaatccatgaatgcttggaaatcaataagagaatcatccaggaaaagcagggaaaagataagccggagagaggagctgatttgggtgtaaggacagtgtagtataagcacaatgagtcggaggtcacggatgataacgtggcttccggcttttttgttttgaatatttctggcagaaagaggaggtgttctgttcatagatgaagcgtatgctatgaagagtgacacagctattacagtgctgcttcaggaaatggaaaatcaaagagaaaatgtgattgtcattcttgcaggatacaatgaaagaatgaaagtatttatgaagagaaatgaaggattgaaaagcagaataccatattgaattgattttccagattacacaacagaggaacttacagatatttttaagctgatgatccatgaaaaaggattctgtgtgacagatgacgcaatcaaagaggcgcattatatctttgaaaaagttagaaatatcgatgattttgggaatagaagatatgtacgtaatttgatggaacgtgcggttagacagcaatccgtaagattactttcacaaagaagaaatctgggtgatattcaaaaggatgaactctttcagattacgaaagaggatatccagatgcttggagagggagaaaagaaggagagaaaaccggaaacggctagaaaagaattagatgacatgatcggtttagcttctgttaaaacagtgattcataaagcgattgccaaacataagataaacaagctttgtatggataaaggtcttcgaatggaaaaatcttctttacatatggtctttacaggaaatccggggacagctaaaaccacagtagccaggctatttgcagaaattatgaaagatgagaaagtattatcgacaggcgtgtttgtagaagtggggcgtgcagatcttgttggtgatcatgtaggcgctacagcaccattagttaagaaaaagtttaaagaagcacaaggaggagtcctttttattgatgaggcttattcactgtgtgacggctatgacaatggatttggcgatgaggcaatcaatacgatcgttcaggagatggaaaatcatagggataatgtgattgtaatctttgccggttatccggaaccaatgaaggcgtttcttgacagaaatccgggtatgcgttccagaattgcatttagcgtagaatttgatgattacactgttgaggaactttgtgagattacaaaattgatgctttcaagaaaacaaatgacaatcacagaggcaggaatgaaaaagttaaaaaagaatttcgagagcgtaaaagatagcagagactatggaaatggaagatttgcgagaaaaatgttggagaatcttatgacctggcagtacaatggcagcaagtcaaccattgatgagtttcggacattgagccgggaaatgcaatatgaagtgattgattttataaaagactttatgatttacgaagaactgacagttaatggaaaaaactatttattagttcacggaggattgggaaattactatccgggaaaagatattgaagaatattccttaaaagaattgatatgggacagggctgagtatgatatccaatattttgaagatacatacgtggtaacaggacatacaccgacacaaggaattatggggaatccaaaaccgggttatgtatacagggagaatcatcatattgcgattgattgtggctgtaatcgaagaaatggacgtttggctgcagtttgtctagatacaggacgggaatattatgttgaaaataaggtgggaaaacgaaatgattgatttacaatatgcgaagaaagcttttgaaaactatttgaatgattatgaccaaaaaaatgaaaagataaagttgaagattgtgcatactcatggagtgatggaatgcagtaaaaaaattacagaagatatgaaactgtccgcagaggattgtgagctcgctcagattattggattgttacatgatattggaagatttgaacaattgaaatgttacaacagttttgaaccgggaacgatggatcatgcagcattcggtgtgagaattttatttgaggagagactgattcggcgttttgtcgaagaaaataagtgggatgaaattataaaaacagcaataggacatcatagtgattactgcttaaaaggaattacgaatgagcgagaattgatgcatgctcaaatcatacgtgatgcagataaacttgacaattgcagagtgaagctcgaaacagcaattgatattctcatgggagttactgcagaacaggtaggaatgtcagaaattacgccagaagttatgcggcaattcaaaaatcataaatcagttctattagagacaagaaagacaaagatggattattggatatcttatcttgcatatttttatgatataaattttaaagcgacatatgaaagtataagagataaccattatgtggataaaattataggaaggattccgtatacaaatccagatactggaaaacagatggaacaaataagaaacgaaatgaatctatatattcaaaacgctataaatgagaatggaaattacagataaatataattgagattttgaaggcgatttacaattttcagcatagtgaacagaagatgaataatatatgtaaggtggtaggaaatggcttattacataacaggagattgccatgcacattttgataagttaatctggttggcaagattcaataaagaacttggaaaagaggatgtgatcattttattgggggatgtcggattaaactattttggggctgacaaagatcgggagaaaaaaatacttgcggattttccaaattatttcctgtgtattcatggaaatcatgaggaaagaccttatcatatacaaacttacagaacacaaatttgattagattattcgaaatggtatttcggacattatcatgacaatattcaatatacagatgctcaactactgtatgaagaaatcaaagagttaggagaagcagattctgttcagaaagtaggaagaccaaggtacagagtaggagaaatggtgtattttacctttggaaaagaggacgcaagggaaggatacgaaacggattaccatggtttgaatcagaacagccggatgaagtgataaaagaatatgtggaacagcagttggataaagccaagtggaatgtggatatcgtactctcgcatacagtaccgattgaagcggaacccgtgtgggcgtttattccagggcttgatcaatcagcagtggacaagacaacggaaaaatggctacagaagatttatgacaggttagatttcacagagtggtatgcaggacattaccatgtagaaagtgaggagtgtggaatacgaattatgtatgaagattatgatgaaatttgtgctgaaaaggaaaagttttgaatatcatagcaaataaactcatgctaaaggggaaagagtatgcgatcagctttttagatggcggtggatgatgacatccttgtaaagaatccattcggatttcagcttgccggagtattggtaaatgacgcagtcacaagagaggcaatttccaaaaaccagatgagaaagttcctaaagtttgtgcatgacgatgtggtgtactgtaaatattatgaagtggtgtacatactctttcatacgggaacgcgaatatcagaattttgtggactgacgctgaagaacattgatcttgagaacagaaccgtaaatatcgaccaccagttgcagagaacatcggatatgcgatatatcatagaaaccacaaagactgatgccggaacaagggcactgccaataacagaaggatgtagcagaaatgtttcaggcaattatcgaggacaggaatgctccaaaagtggaaaaatccattgatggctacagtgggttccttttctatgatgataatggaatgccccttgtggcaatgcactggcagcaccaatttaatcatatggtcggcagatacaacgatatctaccgggtacagatgccaaatattacaccgcatgtgtgccgccatacctactgctcgaacatggcaaaatcgggaataaatccgaagactcttcaatgtttgatgggacattcggacatagcagtaactttgaatgtctataaccatgttggacttgaagatgcggagaaggaacttcacaagatgcagagtatggaagatgctagaaaagagatgggactttcagataaggatgatagaccattaaaacagaatatgttcaaagtagtgtagtgagttataaaattagcacttaggcagaaattaatatgatacctctgaagtagacaaggtaaataaccaaaatctactttggaggtatttttatgggaagaaaacccaagtgtacggttgaagaaaaaatttctgctgtcgaggattatctgaatggaatacgttctgtctctgaaattatggtagatttatctataaaaagtacacgaactataagagactggatactggcatatcaaagtgggggaataaaagccctctgctctgttacagctaaccattcctattccagtgaatttaaaattgaaatggttcggaagtatatcaacggggaaggatcggttaccgatttatgcgccagatatggaattcctgcacatgcaacactacaaaaatggatttcgttgtataatgccaatagagaacttagggattatgatcccaagagggaggtctatatggcagaagcacgaagaaagacaacgttagctgaacgtaaggaaatcgttgaatactgtattacccataaccgtgattataaaggaacagcttctctatatgatgtttcttatagccaggtgtactcatgggtcagaaaatatgatgctgttggggaagatggactgtccgataaacgcgggcaccacaaaacggatgatgaagtcgatgaactggaacggctgcgccgggagaacctgcgactaaagcgccagcttgaagaaaaagatatggtggtggaactgttaaaaaaagtgaaggaattcgaaggaatgtgaggcttggaaaactacggtttgaatcaaaatatcaggcaataaaatatttttacgaaaaaaagcaatggagtgtcaactggatgtgcaaacaattgggcatatcacacgctgcttactataaatggctacaccggacaattccagagcaggaatccgagaacacaaaactggcagaactgataaaggagtatgacgagcggttcggacatatcttgggatacaggcggatgacaagctggatcaaccatttcaatcacaccagctacagcaagaacagggttcacagaatcatgaggaagctgggaattcattctattatccgtaaaaagaagaagaaataccagtcgtccagaccggagacaacagcggaaaataagctgaagagggaattcaatgcaacgaaacctaatgagaaatgggctacggatgttacggaattcaaggttcctgagactggcaggaaactatatctcagtgtcatcattgatctatatgatcgctttccagttgcgtatgtcataagcggaagaaatgacaataagctcgtgtttgacacatacgataaggctctcaaagataatccggatgccaggccgatttttcattctgacagaggttttcagtacacgagcagaatatttcagaaaaggcttcgagaacaaggcatggaacagtctatgtcccgtgttggacactgcattgataatggtcctactgaaggattatgggggattatcaaatcagagatgtattgtatgtataagataaccgacgagatatctttacgttcggcaatcgacaaatatataaaattttatgccgaagaaagactgcaggaaagattccattgcaaaacgccactggaagtacgaagcgaagcattatcagcggaaaccccgatacaatatccgattgctgagaacaaaagaatagaagcatacaaagcaaaatggtgtgcataaacgtctcataacataaatatccgccacactgagtcaaatgtggcggatatctataaacttattttagattttttacttgtctacttgacagggggctgatcaaatgtctaggtgccttttggtgttagcgccacttaacgattgtgggtgtcaaaacacccgtttagtgatataatgaacttcgtatattcatttaaatggaggtgcttatcatggcagtcccaaaagttgacggacaatttatagcagaggctattaaatatattgatgagaatggagttccttggcacaatacaagtaccaagtatgagtttgtatgggaaaacggtaatacctatccaccaaagtatgtcatcgcagtagcaaatcatttgcagaatggtgcagagatagatgtatctggatataatgctgtcgaagcaaaaaactatcttattgcaaaaggatatgagattcagattaagcagacaaaatacgaaattactataacatcagattctgttacttctactgatgattcattcactatggataatattagtgcaggagatgtgttcaagcctttggatgcatcatttgttgctgtcgatggaactgttatcaaaagaaattatgggaaaggtgagagacggaatacaaaccaaactttaccacgtattgcgtttcaaatttatgaaaaacagattgcagccttgccagtagaagaaaaagaacagtttccaatttgtcaatacgctccagataaggaaatgattcgtggaatttattacagcaaggacgaagcaaaagcacacaatataaatccgttcaatacaatgtcgtatgattatgatgatggtagacagtttgtaatttattcatggaatatctttacaactcttagatttgttcaggagtgtttgacacgtttcggtaatccgggagattccttcaaattggtttatcgtgagaaggacgagaaggaaaatgcagaggaagaggcagcagttgtagaggaagtaaaaccagcagaatttaatggctatctgaatccatattctactatgcttgtggaatctaagaacattatattccgaggtgctccaggaactggaaagacttatcttgcaaaagaaattgctactgacattattagcaatggatattttaatgattatacgatgcttacagatgagcaaaagcaacaggtagagtttgtccaatttcacccaagttatgactattcggatttcgtagaaggactccgtccaaagacgaatgaagatggttctatgggttttgaattgcaggatggcgtgtttaagaaattcgtggataaggctagaagaaactatgagaattctaaaaagtccacagaggtcattgcaaatgaattatctgttcaagaagcaatgaaagagttctttgatgatgtggacacaggaaataacacattcaagactaaaacgggtacagaatttacaatcacagatgtcgatgatgagcatatttatctttcaataccacaaaatgcatccatcaacagtatccgattgaatatttctgaaattagacagatgttagagtctggaagagaatttaacaaattaaaagatattacagaatttttcaatatcaattttacacagcagagatattcctacaatcttgttatttttaacgagattcagaaaaagaaaaaggctgcaaagattataagacaggaagagttgaagaaatatgtattcatcattgatgagataaatcgtggtgagatatctaagattttcggagagttgttctttgctgttgatccaggatacagaggtgtggcaggagaggtttccacccagtatgcaaaccttcatgctgatagcaatgaaaaattctatatcccagacaacgtttatattattggtacgatgaatgatattgacagatctgtagacagctttgatttcgctatgagacgaagattccgttttgtggagcttcgtgcagatgagcgccttgagatgcttgataacttgaacaacgaagagaaagaggctgaggcaattgccagaatgtcagctttgaatgtggaaattgcagcaacagaaggtctgaatgaaaactatcagattggtgcatcctatttcttgaagctgaagaatattgactttgaccagttatggtcagattatctacatccgttgttacaggaatatataaatggtatgtatgatgaagaaggtattatggagcgatttaagaaagcatataaccaagggaagtcggatggagttgatgtagatgagtcgaattaaaataaaagataattcgagaatacctaaggcgtcattgtctggcatatcacttctgacaagcaaaattgcagataaaactttggagcagttggagaatgaagggatatttgtattcccggaaattcttagagatgcagatgatatcacaaaagaccagatgattttacagagtgtaaacaattattatttgtcaagcaatgtcatgggcttcatgggacttggagatgagaagctcatagttgaatcaagatttagtggtaacgggcaggacttcctgtttcaatatttgcttgagagagtatttgatgtcccgaatattgtggatttggaaacagatgcgaacaatgatgattgtgttttcaatctgcttgtttttatcttcccacattacttaaagagtgtcatgcgtaagggtgtctttaagacttatgtgagaaaaacatacaatgacagcaatgttaagggaacgatagatatagcgagacacattgttaagaatacaccatttgttggtaatgtagcatattcgcagagggagtattcctttgataatgatttgatggaattaatccgtcatacggtggagtttatcaaacataagtcatacggacataaactgcttgcacaggctaaggatgaggtcaaggatgttgtagcggccactcctaactacgagatgtgtaaccgacagaagattatcgatgcaaataagaccaataccattagacacgcatattaccgagaatattgtgaactgcagagcttgtgtctacttatcttacagcatcagaaacatcagattggaatgggaagcaagaaggtatatggattgctctttgatggcgcatggctctgggaagagtatatgaattcaattgtggacgagattttctatcatccgatgaacaaagctacaaaaggttttcagcgtttgtttgaccataatcgcggacttatctacccggacttcatcagcagagactcagaggcacgagtgattgcagatgcgaagtacaaaccgattgataatattggaaacaaggactatctgcaggtattggcatatatgttccgatttgatgccaagaagggattttatttttatcctgaaatgggagaggaagaagatgctgttatgtggctcaatcgtggttcgacttatgagaagaatgtagaggcacgagaggatatttgtctcatcaagcacggatttcagattccgaccgggatagatgtatatagtgttttcacagagcagatgcgatgtaatgaaatcaaattccttgatggaattttaacgtccgtgaaataggaaaaatataccttttaacgatgcaccccctcggtttagaaatactccaaagggggtgcaaaatccagagtagtaatcccgaaaattttgactacgattttactacgaatgaggggtgtgaattgcactgttttgccgtattttgcaaaatcggcacttaaaatgtaacttttataaatagaagaaacaagtcggcaaaatgccccaaaacacggcatttctcggctttttatgataggagaattttatgataagagttttattcatctgccacggcagtattttccgcaaacgctgaaaaccttgaatttatcgtatgttttggactctaagggaacattttactaagaatttactaaaacaaaaaattagtaagaaatccctagcacgaatttagaaatgaatatgaaacttaggactttattagttgtgaaaaacaattagtaaagtcctttttatttatctaaaggaggatcagaacatgaacaacacagcgttaggagcagaaaacaaaaaggaacagacaatcaattttatcagcgaagcacatgaaaaattctactatgaaaaattaaaagaggtacgctatcaggatgtgtaccacaaggcactttgctattgccttggtatcagcgatgatacgagaagaaatgttgatagcatctatgattttaagacgggatgtgtaaaaactgagtgtctgcatgaaggctggcagaccagtggcagtatgaaggtggtgcgaatggcatttaacctgtattgcaacggcacaccgagtgtagatgattacacaaaaacagaggaacaggtaaacgagtgcaggcagtatacagtggaggacttgttctgctgagcctatgcacctttcttttggcaggcgatacagatccgctatccggagtatgcgacttataaccgggaactgtatgccttatttggaggagcagattgatgttaaaagttcgattgatgggaacaaagaatgatattaaatggtttgggaagattttgcagagaaatctcaagattgaagtaacagagttttcagatttatacccgaataaagggacaaagaagttttacagagcgtatgtagaagtgaaaaagactaatgtagcagaaagttagcaaagaataaaggagaatgtatcatgtgtaaaataatagcaatcgcaaatcagaaaggtggagtcggaaagaccaccacaacaagcaatttaggaattggattagcaaagcagggcaagagggttctgctgatagatgcggacgcacagggcagtttgactgcaagtttgggatttacagagccggacaagctggaggaaactcttgcgactgtgatggcgaatatcatcaatgatgtggaaatggaagatgattacgggattttaaggcatgaggaaggaattgaccttatgcccggcaatatcgaattattcggtctggaggtatccttggtaaatgtcatgagcagggagcttgtgatgcgttcctacatagagcaggtgaaagacagatatgattatatcctgattgactgtatgccttcacttggcatgataaccataaatgcatttgcctgtgcggatagtatcttaattccggtacaggcggcatatctgccagtgaaaggtctagaacagcttattaagacgattggtaaggtgaagcgtcagataaatccgaagctgtccattgagggtattttgctaaccatggttgactgcaggacaaattatgcaaaggacattagtgcattactgattgagaattatggcagcaaagtaaggatatttgagaatagcattccgatttccgtaagagctgccgagatttcggcagagggcgtcagcatctatcagcatgacccaaagggaaaagtagcaagtgcctatcaatctttgacggaggaggtgcttggcaatgaataaggcaggaagtgcggcaaaggtaaagctaaacagttttgatgatttattcggtgcttctgatatgacagcgggcaccgatcaggtgcaggagatacctctttcagaactttatgagttcagaggacacccttttaaggtactggacgatgagaaaatgcaggagacagtggagagtatcaaaaattatggtgtgcttatgcccggtattgcaagaccgagggcagagggcggttatgagataatcgctggacaccgcagaaaacatggctgtgagcttgcaggtctttccaccatgcctatgtttatcagagattacaatgatgatgaagctacggtgattatggtagatactaatatccagagggaagatattctcccaagtgaaaaggctagagcctattctatgaagtatgaagccatgaagcatcaaggcaaaaagggaaaaggaagcagtcttgatgaagtgggagaagcagctggagagagtggcaagacggtccagcgttatatatggcttgcacgtctgtcagatgaattgctggatatggttgataagaaaaaaatcggtctggtacagggtgttgacatatcttttctgacagagcaggcacaggaatgggtgcaggttattcttgaagaaacgggtgtagctatatcgactacccaatcatcaaagttaaaggaatatgggaaaaacggagagctgactctgccaatggtaagactgatattgacggaggaaaagccaagggaaagaaaagttacaatcaaggctgataaaatcagcagatattttacggaggattattccagtgaggatatagaaaatattatctatcagctattggaagaatggaacaccggaaaggcgtcgaataagcagtaaaggaggcacggtaaggtgggcgatacaataaactttgattattactacggaattgaagcagagcagttctctttttatcgtgttccccgacttttgattaaagacgagagatttaaggggcttagcagtgatgctaagctcctctatgggctgatgcttgacagaatgtctttatccatgaaaaacggctggctggatgatgaaaacagggcatacattatttatacggtggatgccattatggaagatttgggatgtgcaaaggcaacctgcgttaagattatgaaagagcttgataccgaaaatggaatcggtctgattgaaaagaaacgccgtggacttggaaagccggacataatttatgtgaagaatttttctacaattactgatgcaaagacagaggaaaagaccgataatgctgataaaaccacagaagttcaaaaactgaacctcaagaagtctaatatgcatacttccagaagttcagaaattgaacttcaagaggttcaggatttagaccaccagaagttcacaatgcagacttcaagaggttcagaaagtgaacttgcagaagttcataaagcagaccctatttatactaactataataaaactaaccagagttatattgatatgagttataccaatcctatcaatcaatctggcaatgagagtaagtcggaaaaaaggattgatttgatggatgatgtcaatgcatacatagaactgattaaggataacatcgaatatgagcatcacatgaagtacgatgactggcagaacaaggctttgtatgaggagctttttgaggttatctgtgaggttgtatgcgtaaagcgtacaacaatccggattgcaggagaggattatccttatgagcttgtaaaatctaaattcctgaagctgaatagtggacatctggagtatgtgattggctgtatgcatgatacaaatacgaaaataaccaatatcaaggcatatatggttactgctctttataatgcaccctcaacaatgaaccattattatcagcaggaagtgcaacatgatatgtatggaggtggctggcatgaaaaaggcattgtttaaaataattattccggtatgcgttcttgttctttggatgattacctgttatccggtttgtaataaagcagatgggtttgattatttcctttattggattttggtaggatgtccctatggtatcagaaaaatgtgtatgtttcttgtgccgaagaattttggaattgcaggaagtatgggaatactggcactgaattgtatcgttggaggtctgattggtggtattattgttcttgtgaggattatcgttatatttacggagataataaaagtattagcaggacacttatggacacaatgtccaaaggtgtaaaagaaaaaagggcaacaaaaaaggcattgtcaatcaatcataaacaatacctctacttgtcatctggaacatattccataatatcttcaatccggcagttaagtatctgacatagcctgttcagaataatggtctttactaccatattttgccggagccgctgaagctgtgctttgtcaatgccataatctttaatgagctggtactgactgatgttcttagccttaagcgtttgccaaaggggatcatatttaatcatacaggcaactcctttcctaacttgtattttaatggcagggaacttataataatatggtgcgtgtatgcaccataaagtatgtaaatggtaaagacaataatggtttatttctggagattgaggatatagatgcaggtagtgtggttttgaaacaggaggatggttaattgtgaaagaaatatacattacagacagtgaaagggaaaaatgcagaaaggttgcagatgcttttgcagagctgtatgagattgagaatatacttgtcgtggatgcgggaagatacggatttgttaagttacagtattatagaccgccacagggttttgaagatgcaataacctttacggatagccggagcatgtttgaaaacttgtgggaggaatggtttgacacgcagctttttcttctggcaaaaggaataccgatggcaggaatgggatatcatgagatattccgttgtctgccaaaggagaaacaagaggaacttatgaatagaaaagccgggtttgcgaaaacggcagaaatagaataatcaggtaacagcgttagggcagttatgagtgaaatacttgtagctgctttttttgtgcttttggacacgatgtccagaagcgggaaggagagatatatagatggaatcaatgagagatattaacagggtaatggagcgtgagatagcgaaggggagctgccctttaaagctggatcatattgaattcggagattattcgtatcaggagataacatcaaaggaaaaattgctggaggtgttatcgtatttgttgcggataggtgatttcaagcagtatgccggaaagacgattctaaataatgtttatatggacctgcgagggaaaaagcctgtatttaagagaaccaagacagctatggaaagaaataatatatttgcaacaatcagaaggtatgcaaagaagctaaagccgcagtataatggagatgtatatctggaaacggtcagatgttattttgatataccgaaagaaaatctggaaaagtgccgatatacatataaagggaacgaaacatacgcctttccaatgtcagacaagtacattatggcattgtatacgcattgtctggtgacgaggaaagcagttgctacacaaggagtacagatcaagggttttacagaaaaagagtatggaatggtaagactggagaatgtgggggatgttttgtttcaggcgttgctatgggatagaacgaaaagagaagggcaaattctttgcacagatttttgtagtatctttattttgtaatatttttttagtgaaatggagggaataaaatgcaatttagtgatgcatatgaaaaaatattatcttatgactttttagatgatgatacaaaaaaacacatatatttagaagatggcgataaacatatgtgtcgtttttgtggagagggagaggatgagactgtatttgataaatcggctcatgcaatttctgaaatggtagggaatagatggttgttttcatatagagagtgtaaaaagtgtaatattgcttttggaaatacttgtgaggatagctttggtaaatttgttctaccattgaaaattgtttcgcaagtttatggaaagaaaagaagtattgggtattcaaatgaacattctcaaataaagataaataaagaagatgcaattttaccagaatttagtgaagatattaaggcattgataaaatcgaatgaagaaaatagtgtgttgattccggaaaaggatggatttattcttaaattagtaagaaaacgatatgtaccacaacttgtatatttttcattgttaaaaatggctttgactattttaccatttgaggaatatgaaaaatatgtacattgttatgcaatgctatatgcagtaagtagggaagaggaaaaaactgatggaataaatgtgtatggatttgaggaattcatacctggaccagaaaggtttaagtgtactaatgctgaattgtatagagtgaaagatatgtctggtaatagaccatatatgtatttttgcttgaactttgggaactattcattgcagattcctcttccaacagatcagcaacaaagaggaaaaagtatctctgtagtaggttgtaaacaccatgacaagtcggaaataagaatattaaggtttaatgaatttgaagaaatatttcaatgccattttagtgctgttatgaaggaagtggtaggagaagaaaaagagagattggccaaatgtttaaacttggaatttcaaaatagagctgaataaggaaggaacgaatatgaagtgtgcatattgtggaaatgaagcaaaaggaacgaaggaacatattatttcatgtgcaattttggatttatttccggagtgctatatcacatttgataatgccagacacacatcgcatgaatctgatccaatggttaaagacgtttgtgctgtttgcaacaatcaaagaatttcttacattgatagctatgccaaagattttattgctcaatattttactaaaaaatatcgtgaagatgatttggtcgaggtggaatatgactatgtgatgatacagaagatgttattgaaatatgcgtttaatgacatgaggtcacataaatgggattgttccttttttgaacaggagattattcattaccttatgaacgaagaagataatgtcccgaaagataatgtgactgttatgtgtggagtggctgttaatgtctcgcctgttccagatgctatgtttggaaatttaaagctacgttggtgtaaagaccctattttgtatgccaatagtacaataagaaatattgattataatactgggcaagtttacctgaatgataatattgagatagaaaaatttgaggacttagcagtttcttacttgtttaaatttaatagtgtgcagtttttgcttatgtgttggaataaagagtcagataaaattaagcagaataatattgtattggaatgccaatatccatatcatttgatgaaagcagaagaaacaaaggcagttttgccaatatgtacagatgaatctaattatcatcattttgagcatattcatgttcgttgggatggattatttgaagttgggcttatgagaaaatatgcaagtggaggaaagtttgtacataaggaagaatatgaaaaagaatgggttaaggaagaacaaaaaattataaaagaacacccaagagggaaaaaataattacagcgtcaaggcagttataagtcgagagatttgtagctgcccttttttattgctgttggacacgatatccagaagcggaaaggagaattatgaggtatttattacatcggctgtatgttccgccttagcggagcatacgcacaggaagatgcagctcggaggtacttatgcaagaggaagtaacgcagaaaacaatcgctcttgtaattaagatcgctaaattggatgccaacgtcttgaaggttgcaatgcggatgtatctgaaccaccgcaggcagaaaacacagaaaacgcatggtaaaacttctgtgaaaaagctggttggtgaaggcgtgggagtttcgtctatcgaagtgacggacggcaatatcaaatcctttgagcgggtagctcgtaaatataatgttgatttcgccgtcaagaaagacaagacaacggacccgccgaaatatgtggtatttttcaagggcagggatgccgatgcagtagcacaggcattcaaggaatttgtttatggtaatgagaaacgaaagggcaggacttccgtaagggagaaactgaaacgctttagggatgcagtatcacagaataagaacagagaacggagccgggaaaagaataaggacagggggcagagcccttgagtaacatcattgaaggcataaccaaagacctgacggaaatcccgaaaaatctgaaagaaaaagcaggaggtatggataccaagaagctagtgcttttgaatctgccctatatctttgctgggtatttctgtgacaaggttgcatggttgtggagagtatcggaggggacaaatgcttccgataagatgatggcagtcatgaaccgctttgataagctgtttgccaatcccttgcccagcttccacccaagggatttactgattggtgtggcatgcggcatagcactccgacttgtggtgtattacaaagccaagaatgccaagaagttccgacagggtgtagaatacggttccgcaaggtggggaaatgccaaggacatagagccatatatggattctgtgtttgaaaataatgtccttctgacacagacggaacggctgatgatgtccggcagaccgaaagagccgaagtatgcaagaaataaaaatattcttgttatcggtggttccggttccggtaagacttgcttttttgtgaagccgaacctgatgcagatgcactcgtcttatgttgtcactgatctgaagggttagattttaagaatacagagaaaataggtcattaaaaaatgaagtgttttctgtgtgttcttattttttagcattatgaaaggagctgagaaaatggctaaagataatagaataacagcactttacgagcgtctgtcccgtgatgatgagatgcagggcgaatccaactccataacaaaccagaagaagtatctggaagattatgcagtgcaacatggctttggtaatattcagcatttcagtgatgatggatattcaggaacgaacttcaacagaccggcattcaattctttgctgacagagattgaagccggcagagtgggaacagtgatcgtcaaagatatgtcccgatttggcagaaactatctgcaagtaggtttctatacggaaatgatgttccctaagaaaaatgtccgttttattgcagtaaataacggagttgacagtgccaatccggcagataatgattttacaccatttctgaatatcatgaatgagtggtatgcaaaagataccagtaagaaaatcaaggcagtgttcaaggcaaaaatgcgagacggaaaacgtgtcagcggtgcagtgccttatggatattacagaaagcctgaggataagcagacattgtatgttgatgaagcttctgcttcggttgtcagacgcatttttcagcttgcttgtgatggaatgggtgcaaccgcaatagcagataccttgtcagaggataaaatccttattccttcggcttatgcgagacagaatcatcctgaggattgccagtgtacgaattaccatgacccttatacatggaatgctacaacagtgggctatattttgaacagacgtgagtatttggggcataccgttcttgggaagacaacgagggataattttaagacaaaacggaaaagaattgcaaatgaggacgaactgcttgtcttttacaatacacatgaagctatcattgatcaggaaacatatgataaagcgcagagaatgagaaaaagggtatctccaaggcgaaacagtgaaaagcctgcgcacaggctgtcaggactgctttattgtgcggattgtggaagcagactggcatatatcaattcaaagccaaaagatgggaaaatatatgacagcaatcaggcattccggtgtagccggtaccacaataaatatcattcatgtactggtcactatatcaaggcaagcacaatagaaatgctgatttatcaggcaactaagagagtgtcacagtatgtccttaaagatgaaaaagagtttgtagaacagttgaaagcacagtatgaattgcagtgtgaaaaggataatacagatgataaaaaggagttgttagaagcaaaacgtcgtatgatggatttggatgatctgataaaaggtctgtatgagaatttcacactggggcgattgccggagagacagtttaaccgccttatgacagaatatgacaccgaacaaagcagcctagagcagagaatttcagaacttgaaactgctacagaacgtatatccactaaggcagtgcagattgataaatttgtgcgactggttaagaaataccgagattttgaggaactgacaacacctatgcttaatgatttcattgaaaaggttgtaattcatgaagcagagggtggcagaacaaaagaccgtactcagcaagtggatatttatttcaatttcattggaaattttgttcttccactcagtgaggatgaagtggaagccttgtagtcagaggaagcacgcagagcggaagagattgctgaaagaaagagaaaatcttctaagaaatctacgcagaaaagaattcagaagcgtgcagagatcaaggcaaaagcagaagctggagatcctgaagctatggcagaatataaagcaatccttgaaaaaggcagacagaacaaccgtaagagatctgaaaaaatgcgagaattgagaatgtctgaccctgaatatcgggcgaagatggaagagaaagaacgcttggcattggaaagggaaaagaaacgtcaggagcgtgctacaaagaagaaaaagattgctttggcagaattaaaggagcaggcagaaaaaggcaatcaggaagccgtcagagagcttgaggagagtagagctattgcaagagaacgttcaaggaaatcagcagaaaagcgtaagcagagagcagaaaatgaccctgaatatgcaaaatatttggaagagagaaatgcagaatacaacagacggcataccgcaagaagaaaggagcagatggaagccttgagagccagggcggaagccggagatcaggaagcaaagagtcagcttgcagagcgtaaacagtatcaggttagagccacagtgaagagctacagaaaaatgcgtgaagatgcattgaatggagaccctattgcaaaagagagatatgaaaaaacactggctatgagacgtgaagcgtatcacgcaaagaaaagtgaacagacagcctaagagtaagcataatatcacaatataatagttgcagaattgatgagaataagcgagagcgatgcaattattgtaatggacaatgaagtatggtattgtatagatggtttaccaaatcgaaagttgtggaggtgaaatgaatatgatgatgttcttaaaattaagaaatatctgagttcatagaactatgttaaatagttttatgtataggcagaacccgaaaaactatttaataaaggagattgtgcaatgatatttcaagataatgtaatcaaagagtacttaaaaaatgtttattttataacgggaataccttgtggaggaaagacaaccgtttcacgtgcgttggcggaaaagtatggatttgaactatttgatgttgatgagagattcgacgagcacaaaaaaatgtcgaacccattatttcagcctgcgatgaatacgtattttaacagtgcagatgaattttttggaagaacagttgaagaatataagaattggctgttgaataatactcgtgaacagttagagtttgttcttcttgatttgattcgtttatcagaaaataagaaagttttgtgcgattgtcatcttacagttgctcaggcactcgctttttctgaaccagcgagagttgtttttctcataaaagacccatctaatcttgttgatgaatatggtaatcgaccagatcatcagggattttttcagtacttaaattcagcgactgatatagaaaaagccaaacaaactgtgaatattaccttatatgaactcaatgtaaatcgcatagaggagattaaaagcagttctttcttttggatagagagaactgtggatagtacagttgagagtacattaacttgtgtcgaaaaacatttaggtttaatatagttgaagaaagacattcgattatagcacattttgtttaatgaattagtgccacaaattgagaagtattcttgatttgtggcatcttaataaggcagaataaaggaataaaaagaatcttaattctgttaaacgctattgacaacttcatatttagtgaatgataacaatttataatttagtattggataaagaataaaaaaggaagtaagttatgacgaataaagaaataatggatatagcaatgcagcaatctgcatatgacacaaatgcaaaggtttctgacttccttcaggatacaaatgtatttgttaaatctggagttggacctttggcaagaaaatattataaagaacctatcgcttgtaattttgtgtcttatggaagcaatgtagttgcatctgtgaaagatgaatttaaagaaatagttgaaacatatctgagtaagtttgaattttatcattgttttgagacgcctaacatgcactggcttgatgaacggatgaaagaaaaaggatatagagtatgttttatggcagagtattttttgccggatatggaacgattgaaaagattagagtgcaattatgtccttaaagtgttagaacaaaaagattttgcagatttgtatcttccaatgtgggggaatgcattgtgtgcagatagaaaagagttagatgttctgggagttggagcatatgatggtgagaagcttgtaggtctcgcagcgtgttcagcggattgtgataatatgtggcagataggtgtcgatgttttgcctgaatatcgaagaatgggaattgcttcatcactaacaagtaatcttgcaattgaaataattgaaagaggcaaagtaccattttactgctgtgcgtggtcaaatcttaaatcggtaaaaaatgcattgcgcagtggttttgtgcctggatgggtggaaatgacggtaaaagcagcaagcttagttgatgaaatgaataagtaataaattccgattttcagaacaataataaatctttattgctatttagtgaggtgtaaatatgtcaactggaattatgataattggtccatctggaagtggaaagacaacacttggaaaaatagttgcacagaaactgggatatctatattttgatgtggatgattatatttggaaacagaatacagatagtccatatacacaaatgtatacgagggaagaaaagattagcagactgaacactgatattgctccatatgaacattttgttatggctggttcgatgagttcctttcattatgcatttgatgatatgtttaaaatgatggtatttctttatgttgaaccagatattcgaatacaacgagttcataaaagagcaatagagcgatttggaagaagagtacttgaaggtggagatatgtatgaatcccatatgaaatttttgaaagataatcgaagttatgaagaagatggatcaccaaatatgagagaacagaaagaatggatgacaaatatgtcgtgtgtaaaaattgaattggacggtgctacggaccttgaaagtaacgcagatattattgtaaacaattggagtgggatagtggaataaattttagtttattctctcaatggggatagctttgaaaattgaaattttatctatgtaaagaacccgcaaatttcaggttgtcggattgtaaaggcagagccttacgcaaggtgcaggagaaagactccgctcgggttaagggcgaagcgccttagccggtcaagggtgcaaccattgcccagttagtggtgtttcgccactaagtactgggtattgcttgtagcaaagcttcacaagattaagcaacttcgttgcaattcccttcgggaaaagaactaaatattgttacgataaacagactgagtagagagatttacttggtctttttttatggaaagattagcatgaaagcaactaggcacaatggacggtcaggcaagcatggaacctatgacgcaaagcacaatgaccgcagatttgatgtagaaaatagtgagcatattgacgcagagagaacgaagatgaatgtgtactgggattgttatcaggggtacagcctgcagaatgataaggacgagcaggcgagattcacttttacggaaatagaaaaagcatattatgttgagaaatattcagaccatgtggacggtcagaatgagagaaaccggaaagcaagacactatgaccgagtaaaaacgattgatgctattcttgaaaataataaaacatgtccggaagaaactttattacagcttggaaacatggactgggctttgcatcttgatgaagcaacaccacatattcatgaacggcatgtatttgatgctgtgaatcagtatggagaattatgtccccaacaggataaggcattggaagaacttggctttgaacttccgaagccgaatgagaaaaagggaaagtacaataaccggaagatagtttttgatgaagagtgcagaaaactatttatcagcatctgtcagaatcatggactgacgattgatgttgagccggtatatggcggtgcaagctatctggagaagcaggattttatcatcatgaatcagaagaaacgcattgaggaaaaacaggctgttcttgatggtcttgtgatgaagatagaggacgtaaacgcagtcattgaagaagcagtagaccttgcttatgaaaaggcttgtgaggttgtcacaaagcgtgtgaaagaggaaacagtgaagcatgatgttgatgtcgtaaaggactatggagagcttttacagcaacagccgaaagataaactcagtgataaatcaaagtcggtggcttccaaggtcgtaaatgcgattgttgccaaactagaaaaagcatcacaggcacttttgggaaatatcatctctgccctgaatgagccgaaaaataaggttaaggcaaagggacagattaaggaacaggcaagggtttccattcaggcaaaactgaaagagaaacagaagcaggttatggaatatgagaaaaaacaagatgtgcatatcagaaaaaagaatatggaactttaggaagcatttgtaatccattagtggaaatacagatgcttttttattgtccggaaaggattgtatgggagtatttgatgaagtaaaggaaagagtgaccgcaagggaagccatggagagagcaggcattgttttcaatcgaaataacatgtgcagatgtccgtttcatcaggacaaaacggcgagcatgaaagtaaaaccgacagataaaaaatatttttgttttggttgtggggaaaagggagatgcgattgattttgtcgctaaatattataaccggtcaccaagagaagcagccatgcagatagctgacgagtttgggattatctatgacagttcggtgcgatcaccgcccaagccggtaagaagagagaaatatccaatgcagattcttgaagaaacgaaaacaaagacatatcgggtgctgtccgactatcttcatctgctgaaagaatgggagcggaatttcagaccggaaagcatggaaaagattgatgaaagatatgtggaagctgtgcagaatcgggaaaaggttgagtttcagcttgataccctgctgtggggtacggaagatgaaaaggaagcagtgatacacgatttaggaaagggggtggaagatattgagagaagagtcagggaatatcgcaggaatcagggaacagttaatcacaacagacaaaggagctgtgaagcagtgcattagaaatgtggttacagtctttgagaacgacccgaagttcaagggagccattcgttataacatgatgactgacagaaacgacattgttaaggggttagggtggtatcgtgagagtccggcacttacagattctgatatagaccatatcatgttgtattttgaagaacattacagccttacaacggaaaagaagataaaatcggctatcaatgtggttgctatggaaaataagtatcatccgattcgtgaaaaactaggttctctggtctgggatgggaaagaatgtatcaaagatgtgcttcatcacttccttggagccgatcagaacaattatgtctatgaagcaatgaaagtccttctgttagggtgatattgtcaatattggtttacacttttttcacaaggatgttcgaccttatgctgcctcttgtagtgaagtatagtattgttgccgcttaaccatcggaggtagtccaccattagcagagcagatcctccgattattccaataactgataaaatatctccaaataagagtttttaactgttctacagtcatcaaggtggcgtcgtagcgtccataaagtaattcttctttgaatcgtgcccacatactttcacatcttgcattgtcatggcatctgccaccggcactgttcatactttgaagaatgccatatttattgattgcgttacggtacaactcgctagtatactgtgtacctctgtcgctgtgaagaatggcacccggagcatcggatatgctttataggcattatctaaggtttgttcacaaagggcagctttcatattcgtatccatagccagacctaatactgctaaatcgtagcagtcaaagatagctgaaacatacagttttccatcggaagcctttatttcagtcatatctgtaatacacttttcgagagggctctcagctgaaaagtcccgcttaattaaatcatctgatttccgagctcctttatccgctttggtaataccgttcggcttacgcttcggtttatgagtaagaccaatttcttccatgacacgataaaccgttctctcaccaggaatgtctactccttccggctgtttgagctgtaacgcctgatacatacggatccttccatatgtatcattgcattcatcttcgcggcaaatagcaaccatcgcatctgccaacggctgatatttccaaggagtcgcttttgtttttagatatttattgaatgcctgtctggaaacatgaagtgctctacaataaaaagaaattttacccttgatcctgccgtcatccgttttgattgcaataaacattaatctctgttttttgctgacttccgacggctggctgcgaaaaaagcacttgcttcctcaagaaattcattttcttcctttaaacggcggatttccttatcctgctctttcacacgttttctgagctcgataagctcatcattaagtgataaagcatttttaggagtatgggatgcttctgaagcgctaaggcgtccttctttaaatgcttttacccagcagtaaatcgtgccatctggtatgcccagttctttagctgctttagctccacccatttcctgagcaagcttaactgcctgtgctttatattcgttgccataggtcctttgatttcgtgccataatgttttctcctgttctcgtattgattatgattatatcaaaatccttgagaatgtggtgtcaacttttatgatacaacatcattacaaggatacagccgccatcatactaaaaggggcatggcttgaaacactagggtttgagccggggacacctataaatgttgagtgtggcggaggaaggcttgtgattaccagagcagatgaagtaatttaggagtaaaaaagatgagctaagtagtgaactatggtataattaaaaaataaattatgaatgattatcatagatatttatggaggagcaagagatgccaaatatagataaagatgaaataaaagatagtgttgtgattcgtaatgtaacagcaacgtttgtaggtacaaaaggaaaagatggatttgcagaggtaattaaggattttgaaaacgcacaggaagttcgtgttttgacatatagtaaaattggaaatggtaatgacagtgataaaaaattaaaaataattagagaacttgcaccaggaaaaaaattaaggattattgttgcaattccaggattgttaaataaaaaaataaatggtcaaattcacacaaacttatattctgaagatgatattattacgcacctagataaaattaagaatcaaataactgcgatatattcatcagaagatttagagatgtatgtttgttttaaaaaccatgctaaacttgttggaacagaaaatgttctttacgtgggatcggcaaattataacgattatagccataaaaattatgaggccggaatgattatacgggataaaaatagtattaaagaaatatatgaaaaatattttgacaaagttgttgctgtacaatattgtgctgacaaatatgacaccataagattaaatcttttatcattggttgatgaaatagaggaattagaaatatttatacattgctttatatcttgctttgatgaaagagttgaaaatttcaacagcataaagaaacaatacgaggtaatcagtagcagaatggaagatattacaagatatattaatgataataagaaaaacatacccatagcattatcagaagacatatgcacaattgaaaatgatatagataatatttctgagtttatttcgggtgcatttgattcagattataataaaaatatggagtattttgcagattattatgaaaatgagcatatggataacaaaggagttttttcaagtgatgcgtggattgatgaagaaacaccttatgtcatgctgagcgaggagacggaacaggaatattatatttcagaatattggactcaagaaataacggaaaagtcagtggtaaaagaaactttagatttactaaatgctatagtaaaaacagctaaggtgtggttatataagaaaccttatgatatgtttaaagcacagttggttcagattggaactgatgaaaatgtactaaaataataagagaatagtatttgtatcttaaaaaaggtgtataaaaatggattaaaaaatgcaggtgctgatgagaaaaatacatcagcatctgtaaatatatttgttgttgctgattagtttttataattatccatgaggaacactttaaaatgaaacattgatttctcattgtgaaattgaggagtactaggtttaattctaaggtctctagcaatctgacgttttaaatgacccgtcataatcattttttttggttcccaagtttttctatctaattcaccaatcatagcgtaggaggatatattaaacgggagcatttaagaaagaacggatgatgaaggcatatgcacagttggaatatcattacaaggatacagccaccatcatattaaaagaggcatggcttgaaacactagggtttgagccggggacacccataaatgtcgagtgtgacggaggaaggtgttacaagggaagcagtcacaaaagaccagatgcgaaggttcttgaaatttatacatgatgatgtggtttattgtaaatattatgaagtgatttatattctttttcacactggtatgagaatttcggaattttgtggacttacgatgagggatattgatttagagaaaagaaccatcaatattgatcatcagctgcaaagaacttccaaaagagagtatgtaattgagccaacaaaaacaaatgccggaacaatggttattccaatgacaaatgaagtgacagagatgtttcgagcaattattgaggatagaccagattataaggttgaaaaagtggtagacggttacacgggattcctttttctggacaaggatggaatgccacttgtagccatgcattgggaacacagattcaatcatatggtcagcaggtataatgaaatttataagattcagatgccaaatattactcctcatgtatgcaggcatacatattgttccaatatggcgaaagctggaatgaatccgaaagcactccaatatttaatgggacattctgatataggggttacgttaaatgtatatacgcatctgggattaattgatgcaaaagaagagatgaataggattgcaaaactggcatagtatgataaaataatagaaaaaagaattaataataatctgattataaggttcttagaaagcctgttttccaggctgattattactaagaagttactaaatttggataagaaaatatacgaatttatgctgtgatatacaggaaaatgacaggattgaagattatcggaaaatgcctgtaaacagcgtaaatacagcatttcaaggagttttaagcaatgataagagtgttatttgtctgccacggcagtatttgaagaaaatgcggaaaacgctgaatttacggtatatttaggactcaaagagagagttttactaagaatttactaagaaagaaattagtaagaaatctctagcacgaatttagaaaaatgaaacttaggactttattagttgctaaatgcaattagtagagtcctttttattttcaaaaagaaagaggaggttctaaaaatgaacagtacagcgttaggagcaaaggaaacaaagaaggaaaacattatttttatcagcgatgcacatgagaaattctactatgagaagttagaagaagtaaggtatcaggatgtgtaccacaaggcactctgctattgccttggcatcagcgatgataccagaagaaacattaaaagtatttatgattttaaaacaggctgtgtaaaaacagaatgtttgcatgaaggctggcagaccagcggaagtgtgaaggtagtcagaatggcatttaatctttattgcaacgggactccgagcgtggatgactacaaggacaccgaggaacagataaacgagtgcaggcagtattcagtggaggaattattctgctgtgcctatgcaccatatttttggcaggcgatacagattcgttatccggagtatgcaacgtataacaagaaattgtacgccctgtttggaggagcagactaatgttgaaagtaagattgatgggtacgaagaacgatattacatggtttggaaagattttgaagcgtaacccgaaaatagaagttaccgagttctcagatttatacccgaataagggtacaaagaagttttacagggcttatgtggaagtaagcaaaagaaacgtagcagaaaaatagcaggaagaaaaggagaatttcattatgtgtaaaataatcgcaatcgcaaatcagaagggtggagttggaaagactaccacaacaagcaatttaggaatcggattggcaaagcagggaaagagagtgctgttaattgatgcggatgcacaaggaagtcttacagcaagtttaggttttaaggagcctgacaagctggagattacgctggcaaatgtgcttgcaaacatcatcaatgatgaggaaatggatacggattacggtatcctcaagcatgaggaaggcattgacctgatgccgggtaacattgaattgtctggtctggaggtatcactggtgaatgtaatgagccgtgaggttgtgttgcgttcctatgtggaaatggtaaaagatagatacgattacatattgattgactgtatgccttcccttggtatgattaccataaatgcctttgcatgtgctgacagtattctgatacctgtgcaggcggcatatctgcccgtgaaaggtctggaacagcttattaaaaccattggaaaagtaaaacgccagattaacccgaaattggaaattgaaggtattctgctgacgatggttgacagccggacgaattatgcaagggacatcagtgccatgcttgtagagaattatggaagtaaagtgcggatatttgaaaacagtattccgatttctgtaagagcagcggaaatttcagcagagggtgttagtatctttcagcacgatccgaaaggaaaggttgcaggtgcctaccagtcattgacagaggaggtgcttcgtaatgaataaaagaggaagtgcagacaaaatcaagttaagcagttttgacgatttgtttggcacgcaggaagcgggtacaggtacggaacaggtgcaggagataccactttgtgagctgcatgagttcagaggacatccgtttaaggtgctggatgatgagaaaatgcaggaaacagtggagagcattaagaactatggtgtgctgatgcccggtattgcaagaccgagagcagaaggcggctatgaaattatagccgggcaccgtaggcgacatggctgtgaactggctggactgtctacaatgccgatgtttgtcagagattatacggatgatgaagccacaatcatcatggtagacactaatattcagagagaagatattctcccaagtgagaaggcaagagcttattccatgaagtatgaagccatgaaacatcaggggaaaaagggtgccggaaacagtcttgatgaagtgggagaagctgccggggaaagtggcaagacggttcagcggtatatctggctttcccggttatctgatgaactgttggaaatggttgataagaagaaaatcggtctggtgcagggcgtggatatatcgtttcttacagagcaggcacaggaatgggtgcagattatcatggaagaaactggaacaaatatttccactgtccaatcagcaaaattgaaagagtatgggaaaaagggagagctgaccatgccgatggtaaggctcattttgacagaggaaaagccaaaggaaagaaagattacattaaaagcagagaaaatcagcaggtattttccggaggagtattcggaaagcgaaatagaaaatgtcattatagagcttttggaggaatggcagaagaaacagtaaaggaggcggtaaaaatgggcggtacaatcaagttcgattattattacggaatcgaagcagatcagttctctttttatcgtgttccacggatgctgattaaagatgagcgtttcaaggggcttagcagtgatgccaagctcctgtatggtctgatgcttgacagaatgtccttatccatgaaaaatgggtggcttgatgatgaaaacagggcgtatattatatatacggtagatgcaattatggaggatttgggttgcggaaaggacaaggcgataaaagtccttgcagaattagatacaaataaaggtattggtctggtggagagaatccgcagagggcttggaaaaccggatattatttatgtgaaaaattttgttgtttcgcaggaaacagaggaaaagcctgataaaatgcaagtggatagggatacacttgcagaggtcggagatgccgatttgcagaagtcggaaaaaccgaattcaagaagtctgaggagccgacttcaagaggtcggaaaaaccgacttcaggaactcggaaaatcagacttcaaggagtgggaaaaatggacttcaagaggtcggaaattcagcccctatttatactaactataatcaaactgatcagaattatactgatatgaattatatcaatcttatcaatcaatcggagagtgagcagaaaaagcctgattcgatggatgagatggaggatgtaaacgcatacatagagctgattaaggaaaatattgagtacgagcatcacatgaaatatgctgcttggcaggacaaggcattgtatgaggaactgtatgaggtaatctgtgagattgtatgtgtaaagcgtaccacagtaaaagttgcgggagaagattatccgtatgagcttgtgaaatccaagtttttgaagctggacagcggacatttggaatatgtgatgggctgtatgaaaaacaccactacgaagattgcaaatattaagtcgtacatggtgacggcattgtataatgctccctctacgataaatcattattatcagcaggaggtacagcacgatatgtatggaggaggatggcatgaaaaaggtattgtttgagatagtggttccggcggttgttctggcactctggatgattacctgttatccggtatgctgcaaagcagaagggtttgattatttcctttactggatactggtgggatgcccttacggtatccggaaaatgtgtctgtatctgataccaaagaattttggaattgccggaagcatgggtgtatttgcatttaactgtataattggtggtttgataggtggcattattgtgataatgagaattgcaaagatatttacggagataataaaagtgataggaggacacttctggacacaatgtccaaaggaataaaagagcaacaaaaaaggcattgtcggctaatcatccacaacaatacctttatttgtcatccggaacatattccatgatatcttcaatccggcagtcaagtatctgacacagcctgttcagaataatggtttttactaccatgttctgccggagccgctgaagctgtgctttgtcaatgccataatctttgataagctggtactgactaatgttcttggctttcagcgtttgccagagagggtcatatttaatcatacaggcaactcctttcctctcttgtattttaaatggagaaaacctataataatatggtgcgtgtatgcaccataaatatgcagattaagatagaaaaatagatgttaaaataaatggtcgaacagtaacaggagggatttatatcttgaaaaaaagctatattacagaagtcgaaaaagaaaagtgcagacaggttgctgatgcatttgcagagctgtatgagcttgaaaatatacttgtcatggatgccggaagatatggttttgtaaaattgcagtattatacagagaatcagggttttgataatgtatatacttttacggactgccggagtctgtttgaagatctctgggtggaatggctggatacaaaactttatctgatggcaaagggtacaccacttttggaaaaaggatacaaaggtatatttgaaagccttccgaaagaaaagaaaaaagagcttatggataaaaaagccgattttgcaaaaaaggcaggaatagaattataggaataacagcgtcagggcagttatgggtcgagagatttgtagctgctcttttttattgcttttggacattgtgtccagaagcgggaaggagaaaaacggatatggaatcaatgagagatgttaatcgtgtaatggaacgggagatagcaaaggggagcagccctttgaagttagatcatattgagtttggagaatattcgtatcaggagataacatcaaaagagaaactgctggaggtattgtcttatctgttgagaataggagatttcagccagtataccgggaaagccgttatcaataatgtttatatggacctgccgggcaagaagcccgtattcaagagaactaagacagcgatgcagaggaataaaatttttgcaacaatcaaaaggtatgcaaataagctaaagccggagtataatggagatgtatatttggaaacggtcagatgttatttcacaataccggaagaaaatttggagaagtgccgatatacatatcagggaaacgaaacatacgcatttctactgtcggacaagtacatcttggggttatatacgcattgtctggtagcaaggaaagaagctgcaagtacagaggtgcaggtggaaggctttacggagaaagagtacggaatggtaagactggagaatgtaggggatgttttgttccaggcgttgttgttcgataacgttaagtttgaagtgaacagaatatatgtggatttatatacaatttatcattagatgaaaggaagatggttatgagcttttatcaggataatatggcaaatttaatgaaagaatttgtaaaatcagttgatgataattttgataaaaaacaaattcaaaatttgacggcttcgcttcaacaatttagtttagctttgaagaaggcaacagaaaacatatccttaaatttttttacggaagagatgcagaattatattgcggaaatgaaagaaagtgagaaattatcacaatcagaatttgaagcaaaatattcatatgaaatagaagtctgtaaaaaattgggacgtgctggttgggttgtttcagaacattcaaatcctagaaaagttaaagaatggtatgacctgttgatgaatcaggatgatactgagataagcacttattttgagggagataatggctgtattttatctaatatctttcgaggtttagaaaagaaatattgtgtagagccaaaccaaaggtattattcaaaagcgaaatgtttttttgagcaagaggattatatgacatcatcaatgtacttagtagctttgcttgaagcgagaacaaatgaattaatgaattatcctaagggaactcggtataagcaaaaatattcagaggaaggttttgaaaatcatttgcaaacagaatttgataaagtggattctttttttactaagagatatctatttttagatgtgtatccttctattatcgaattcttaaatcgtttatttgtagatggtaaatatacatttgaaaacggagtggaaccaccttatattaatcgaaattggcttctgcatggtagaagctacagaatgatcgaacgttatgaatgtatacagttgtttaatgcattaagtgctatagaatttgctttttcattgtctaataagttggatgtagtagaaaaatactaggaggaaaatttatgacagaaaaacatgcttgtatatattgtggaaatacagaaacatcagaatcagatattattccggacgcattgacaaatgcaagaatcacaaataaaaatgtttgcaaaacagagcataataataaatttagtgatttatttgaaagtgacgtaatcgaagcattggcattaataacaaatgaattggacattaaatctcataaaggagagaactatgctgcatattcagctaaaattgaaattgatggtatagaatattcgacgaagatgacatctgaaaaggacttatttaatggacggaaggtcttggtttctacagatggtaaacataaattaagttcaatggacaaaattacaaaaatcgcacaagacccaagtcaaatatctgaggtagacattaataacttacctttgtgtaaaaaagttgaaatagatatcaatgtttactttagcgaaaaaatgttcagaatgatagccaaaatagcatatgaatggtattgttcaagaaatgatgtagttggttatcatgatgagtttgagaacattgtaaaatttattacatctggggagggaaataatccagttacaattttgcaaaatgaggaattatataagtattgcgggaaacaggttagtttgggtagtcattgtttgtttgcctatatagataatgaagaaaaaataaatgtaatagtttcgctttttggaattgcaatgtatcgtgttgtggtatctgatgatattccagcattctgtgaaaacaattttatgtttatggaattaagaacagattcgtccagaaaggaattaaaacatgtttcacgtgaagaggcagaaaactatttttttgagttgcttaaaccaagtaattttatagaaggggcaaatattgcaggaatgcatattatgattcctaaagtgatatctagtatagatgtcgtagtctacccatttgtatttaatatgacaaaatgctttttggaaattaatgatgagacacgagaaccaaatgagagaatagtgaggatattgaaaaataatatacaagaagtattgcaggcgtcaagtttacacaaaaaatcaatacagcgatttgtgaaagagtatttttcagatggtcatgagccaattatacttaatcctaactcgtctaataaaaagactgtgctacttttttatattctattcgttatcggaagggataatatagaacatattgatgacaagtctttacaagacatagcaaaaaaagcattagatatgggagtacaaagtgaacttatcgtgacggatgaaatagaaaagaaattgcaaagtgagatgttagctaccaaaggatatagtgatttgcttgaaaagggagcagaagttataaaaaggtggaacgactagcaagtatataaaaaattaacagcgtcagggcagttatagaccgtaaaggtttatagctgccctttttgcgttcatggacttttggacacgatgtccagtagcggaaaggagagcttatgagatatttactgcacaggctgtatgttccaccatagcagggcatacgcacaggtaacaatgatcggaggtacttatgcaggaggaagtaacacagaaaacgattgctcttgtaataaagatcgctaaattagatgctaacgtgctgaaagctgccatgcggatgtatttgaaccaccgcaggcagaaatcacagaacatgcatggtaagacttctgtgaaaaagctggttggcgagggcgtgggagtatcgtctatcgaagtaactgacagcaacatcaaagcctttgagcgggtggctcgtaaatacaatgttgattttgctgtgaaaaaagataagacctgcgaaccgcccaagtatttggttttcttcaagggcagggatgccgatgtggttgcacaggcattcaaggaatttgtttatggtaatgagaagaagaaaggcagagtttccgtaagggagaagttaaagcgtttcagggatgcagtatcacaggataagaacagggaacggagccgggaaaagaataaagacagggggcatagtctttgagtaatattgtgcagggtatagccaaagacctgaaagctattccggaaaatctgaaagcgaagctgaagggtgctgacaccaagaagctgatgcttttaaatatcccgtatatccttgtcggatatttctgtgacaaagtggcatggctgtggagagtatcaccggggaataatgcttccgataagatgatggcagtcatgaacagttttgataccctgttttccaatcctctgcccagcttccacccaagagacttgatgattgggactggatgtggcatagcactccggcttgtggtgtactacaaagcgaagaatgctaagaaattccggcagggcgttgagtatggttccgcaaggtggggaaacgccaaagacatagagccatatatggattctgtgtttgaaaataatgtccttttgacacagacggagagacttatgatgtccggcagaccaaagcagccgaaatatgcgagaaataaaaatattcttgttatcggtggctccggttccggcaagacacgcttttttgtaaaacccaatctgatgcagatgcactcatcttatgttgttactgatccgaaggggacggtgcttgtggagtgcggaaagatgttaaaaaagggtggctatgcaataaaagtcctcaataccataaactttgcaaaatccatgcattacaatcctttcgcctatatacggagcgaaaaggatattctgaaacttgtaaacacgattatagtcaacaccaaaggagagggacagcaatccggtgaggacttctgggtgagtgcgactcgttcgcagacggtaaaaagtctgcgcacgagcaacggttttccgttgttcggagaactggtagtttgataggtggaatgacggggtaacgccctgaaacgcctacccttgatgggcgtgcattagctgtaatggctggtgtacgaagccccatgacaaaggctgagagtaaccgtaaccactgcctaaagtggtcgaaagcggtctggaggcagactgtgttacctataagccgagagtctataagatacctatggttagaatgttcgctttggcgggcggactgacgaacctgcgaatgtacaggtctaaaagaagaccacgcagaaatgtgtgggtgcgttaatgcgcagtcggtgtggtttagtagaaattgatcctacgaacgaccatgctgtgttacaggcacaggcaagccgacaggtctatagcaggaacctacgggtatgtatgaacagatagaactatcggaacgaggaaaggcagcagattccgcaaggaatagtctgacgaaaaacaataagcagacgaactgctgctgaaaagtagtggtcgaacctatgatgtgcttgcgttatgtgagctacggaggaatggccacaagtcgattgagataagcaggcattattcaatccaacataaggattcgagtaagaccaaaagggtcactttcgcaaaaaggaggtgatgccttatgccaaagaaaaacaaaactctatgtgtagatgacttacgtcatgccgagtattacggtatgcagccagtttttgatgaactctatcatcgaagtttggagggagaaaattttaccgaccttatggatttaattctgagccgggacaacattcttctggcatatcggaacatcaaagcaaacggaggaagctacacagcaggaacagacaacaaaaacatcagtgacatcgggtgtttaccgcccgaaacagttgcagagaaagtgaggtttattgtcacaggaagtcagcacggataccgcccaaagccggtaagacgcaaagacattccgaaaccaaacggaaaaaccagaccgttaggtattccctgtatctgggacaggctggtacagcaatgtatcaaacaggtcatagagccaatctgcgaagcgaaattcagcgacaacagttacggctttcgcccgaaccgttccgtggaacacgccgtgcagaaaacttacaccatgcttcaacgcatgaacctgcattatgtgattgagtttgatataaaaggatttttcgacaacgtaaatcacagcaagctaatgcggcaaatatgggcaatgggaatacacgacaagcagttgatttttattatcaagcggattctgaaagcaccgattagaatgccagacggcactacactcattccagacaaaggcactccgcaaggcggtatcatttcaccgttgcttgccaatatcgtgctgaatgaactggacaaatgggttgagagccaatggcagaaccaccctcttgtaaaggaatacgggtatgagaggaaaatcagaaactcgattacttttgaccggagcaaggcattcctcaaaatgaggaaaacagggttgaaagaaatgtatatcgtgagatatgcagatgatttcagaattttctgccggaataaagaggacgctttgagaacgaaagaggctgtaacggcatggataaccgagaggctgaggttggaggtatcgccagagaaaacaaggatagtcaatgttagaaaacgctattcagagtttcttgggtttaagatacgagtcagaccgaaaaacaggaagtacatcgtgcaatctcatatctgtgacaaaaagttggaactggaaaggcaaaaactggtggaacaggcgaaacgaattgcccgaccttcagagggaaaaagacctttggacgaaatacggctgtacaattcaatggttctgggaatacagaattattttcaacttgccacctgcatcagcattgattgcaggaaaatccacagacaggtcatgacagttttaacaaatcggctcaatacagaaaccgggtgcagacttgttcgagagggcggcgcaatgaccgagagcgaaaaagaacggtttggaaagtcggcaatgatacggtatgtatctggaatcgaccaacctatctaccctatcgcatacatcaagaacaagataccgatggcaaagaaagcggcggtttgcagttacacggtagagggacgggcattgatacacacgaacctaagtatgaactcatctgttctatcaggtttgaggaatcaaccgtctatggggcgaagcacagaacttactgacagcaggatttcactattctcggctcaacgtggaaaatgtgcgctaagtggggaactctttgaaaatgcggctgacatagtatgctggctgaaaacaccggcagaattgggcggcaaggaacgctatcgaaatatgattttgttccataatagatttcttccactcctgcaagagtgtcctaagaatgagctaaaagagatagccgacacgctcaaggcaacaaaggaactgatgttaaaagtgaacagtctgcgccagcaggctggtttgtccgcaatagaaaactaacatttcatttggtgattgattaaatgcttgtgaaaacaaccgatggaacgccggatgcggtgaaagtcgcacgtccggtgtggagtgggggaaaatccggcgataacttcaaaggattacctatcactataggctgaaaagctctattatacggcactcatcgcttatatctggtatgaagctccggaggaggagcagaatttcgccatgctgattgatctgattgatgccagcgaagccagagaggatgatgagaatttcaaaaatgccgttgatttgctttttgaggagctggaggcagagaacccgaaccattttgcagtaagacagtataagaagtacaaacttgctgcgggtgatatatgctctaagtgacttcttaatcatgattttgtcgtggttagtgaagcaatcacttagagcatttttatttcaggaggtacagccatgagaaatgaaaaaattaccccactgtacgagcgcctgagccgggatgatgagttacagggcgagagcaactccatatccaaccaaaagcaaatgttagaggattttgcccgccggaatggactgccaaaccctacgcactttaccgatgatggtatctcaggcacccgttttgaccgccccggatttttggcgatgatggaggaagtggaggcagggcgtgtagaggcaatcgtcatcaaggacatgagccggttggggcgcgactatctaaaggtcggtcaggtcatggaggttttgcggcagcgaggcgttcgtctgattgccatcaacgacggtgtggacagtctgaaaggcgatgacgattttaccccgttccgcaacatcatgaatgaattttacgcccgtgataccagccggaaaattcgctctgtgtttaagtcaaaaggcatgagcggcaagcacctgaccggcactgtgatttacggctacttatgggacgaaaaacgggagcattggctggtagatgaggaagctgccgaagtggtgcgccgtatcttcgccctcacgctggagggatatgggccttatcagatcgcctgcaaattatccgcagaccggattgaaattcctgtcgtacaccttgcccgcttcaacgagggtgtgaaccgttcaaagccggtcaaagacccctatggatgggggtcatctaccatcgtgaacattttgaaaaaacgagagtatttggggcacaccatcaatttcaagacccgcaagcactttaaggacaagaaaagccactatgtttctgaggacgagtggacgatctttgagaatacccatgaagccattatcgaccagcagacctttgatctggtgcagaaaatccgcagcaatgtacggcgttatccaaacggctggggcgaagcagctcccctcacaggcttgctctattgtgcagattgtggcggcaagatgtatgtccaccgcaccaacaatggcaggcggatttctcaatatacctgttccaattataccaaagttccgtgtgggacactatgccctacacaacaccgtatcaatgagagtgctgttctgacattggtttctgacacgctccgggctatcgctgaatattccagaaatgaccggacggaatttattcacaccgttcaggaaacgcaggttgctcaacagagtgccgatatatcgaaaaagcgcaggcgtctggccgctgctcaaaagagagccggagaactggaaaaactgatttgcaaaatctatgaggacaatgccctcggcaagctgccggatgcacgatatagggcgcttgatgcacagtatgccaaagagcaggatgcacttgagattgaaattgcagagctggaaaaggctgttaccggctatgagcagagccagaaatcagcggagaaatttatagccctgattgataagtacgagaattttgacacgctgacaaacaccatgctcaacgagtttgtagagaaaatccttgtccacgaacgcgtccgaaaaggcagtcaggacaccacgcaggaaattgaaatctacttcaattttttaggacgctatatcccaccatccttgcaaccggttcctttaaccccggaggaacaggaagaactgcggaaaaaagaagaacgcaaggacaggcttcatcagaactatttgaagcggaaagccagcggcgcacaaaaacggtatgaggacaaaatcaaggcgaagaaaaaagcggaaatggacgctaagaaagccttgatccgggctgaggatatgaaaaaaggtattttttctactgtcggacagctaccgaaagaagaaccgcgcaaaggcagcatagcagccaacgcagcagtctaatcatcatggagcaaaggagaatgaatatgagtaagttgacttacattcgttgtggagattatgatatacccaacctaaaactttctgtgcagccggaaacttctatcggcaagtacggcaggatgcgaaaatcctacctgaaggaacatcgtcctattctctacaaccaactgctgatgagcgagaagctgtatccgcacctgatagagattgaccggacaacgcaggagcgtatggacaccatgttacctcacatgatggaggctgcgggtgtcactgagggactaaaagcctgtgaccctatgcgttgggtggggctgatgaacacattaacggcacagattgaggaaattttaatcagggaactgatttgcagctgaatgggaggtgcgggaaatgctgacctttgaaaaggttttgaaagtgtttcaggcatatctggatgatgaccctttgtatgaggtggttcagaccagccacggttatacattgatggcatgggaaccccaccggaatgactggtacagcgcagaaatacagaaaactccggaggatttacggaacgctttgttgggtacatacgccaactttctggaagataagattaccggaaatgaccgcgagctgactgtgacagaaaccggagaaatccagcagaggtgccgggaactttgggaaaagtgccgggaaacttgatatagaaatgccagaaggaggccgcgattatgcgtcctccttctgcttcgcagtctgttccattttgagcgccccgtctatggcaccttcgataatcggcaggtattcttcagggcagagtttcagcttgtggctgacccgttgccgctgtgcgctttcttcccgcatgatctccgggttaaaataccgttccacgggaagtccgcagaccttaatcaactggatcatcacaggcaggctcggaatcgcaccttgattctcaatgttggcaaggtaccgccattcaatcccaaccatttctgccaatgtttttcgtgccagacgctttgcctctcgtgcagctttgacatctgcgccgaaggtttcaaaaccgggacaatcttcaactttcgccatataacatcacccagttacattgtataattcatactttgcccgtggaatgtcgctatatgcaggttggttgaagtttataattcatatattacatcttatatttttcaagaacaggaattacaatagaagggaaatgaaaaaagtaaaagaaaaatttctaaagttaaatccttttgggttactcagttgtatattaagtgtaaggcgttttacacatggaaggcggtgacacggtatcgaagatttcatactaattaaaaaaatccagtcgggtgacacagatgcatttgagataattgtccgaaaatattatcagtcaatttatctattttgttgtcggcgattgaacggcaatccagataccgccgcagatattacacaagatgttttcttgaaattgttggagaatattcaatcagtacgaaagatcgggaaatttcaaaactacctgctaacgattgctgttaatacctgtaacaattatactaagaaagcaaaacccctgtatatggatttagaaactcttgaagatatagaagatactgataatgcctttgaaaaaattgagcttaacgaacttaaagcgcaaattcaatatgcaatcaacacattaccggactatcaaaaagaggtcatcattttacgattttattatgatttgaaaatccgagagattgcaaccattacaaaagctagtgtttctactgtaaaatctaggctccaacaggggattaaaaaactggaacgatatttggctgattttagaggaggcgataatgtatgacccaaaaacaaaatggtgtattagaatggttgcagagttgtgaaacgcctgctccatctgaacctaaaattaaagcagtaatcgtagctggaaaaagttacatgaatagttctgaattcaataaaaattcaatgcgagatattatattgaaccaacttcaatttctgccgctttctttctggattgttcaaataatactcactatatgtgcagtattattagcatgtatcctgggccaatggagggttccattttattatccattgacaatccttgcagttatggttccattccttgcgttattaggtgcaatagaaatatctaaaagcaacatctatggtatgtgggaaattgaacagtctagtagaacaacgctggtaaaaattgtagcaggtcgtatgctgattattggagtaatcaaccttttcctaataacagtcattttaatttcaatggcatatatttaccagaaatcaatgattgaaatggtgttgtatggtttgattccatttaatatttcttgcacttgttatctttttatatgcgcgaaaagcaggacaaacgatagcttgtatcatttaatcgcttgtatgatttttctttctggaacattttctcttgtactccatcagcgatttatatttgaagcgtctatgttctggggatggattggattttatgtgttatctattatcctattagggaaaacacttcaactgtacttgaaaaaagaaaaaatgattggagaattgatatggaacttacaataaatgatctttcaaaagaatatggaagaaaaaaagctgtaaatcatttcagcgcaaaattaacaaatggtgtttatggtctactcggggcaaatggtgcgggcaagacaactttgatgcgaatgatttgcgatgtccaaactgaaacgaaaggagccattttttttaacgggaaaaacattcatgatttgggcgagaaatatcgtaatatcttaggctacctgccacaaaattttggctattatcctaactttacagcgtataaatttttgatgtatatctctgcaataaaggggctgccgcctaaaaaagcccataatcgcacaatggagctgttgcaggttgttgatctgctcacacagaaaaacgaaaaaatcaaaactttttccggcggtatgaaacaacgcttgggaattgctcaagcattactaaacgatccccgtattttgattttggatgaacctacagctggacttgacccgaaagagcgggtgcggtttaggaatctgattagttctttggcagaaaatagaattgtaattttgtccactcacattgtttctgatgttgaatatatcgcaaatgagattctgattatgaaaaatggcgagttaattcaacatggttctccagaagaaattttgaagccgattgaaaaatgtgtttgggaatgtgatgtatctcgaaaagaggccgaagaattagaattgaactatgtaacagcaaatctgaaacataataatggtgcagaacggctgaggattatttctcaagaagcaccatgcagaaccgcttggaatgttgatccaacattggaagatttgtatttatactattttgcggaggtatccgagcatgaatgaaatgataaaagcagaacgaaataaaatatgttcgagaaagcaaacacgaatgttgtttttagctggtatggttcttatcgttgcctattttttcttttttcaatttaattatcaaaatgttttctatgattatgaccttgaaaaaatggcattagcaagcggttttacagccattgaacaacggaaggaagtagcagaaatatttgaaggaaaactctctcaaaatacattacttactatgcaagaaaaaatcgaccaagcaaaacaagcaactgttggacaagatgaaaattctgctttttctgctgttcatgtttatcgtgaccaagcggcgattctggaatatttgacaaattctgatggtagttttaagtcactcgaaacagcatatccaaatagtccaactgtgactttaggatattgcgatggctgggataagctattatctggaatggggagcatcttgtccataatgatatgtttaattgttgtaatcactctatctcctgttttctcagaagagtatgcacttcatacagatagcattatttattcggctcggtatggccgaaccaaactcacaacttcaaaaattatagcggccttggaagttgtaattggcacatacctcttgtatttactgctaaatttagttctgtatggctgtacctatgggttacaggggtggaatgtaagcattcaatcttcattacattatgcttcttcaatatataatttgacctttttgcaaatgttctttatctctgtaatattgaatatttttgggattgtagccttgacaactattacattgtttttaagtgctcaaatgagttctcctgttacagcgcttattacttcttgcgtcatctgcttcttgccagttgtgtttgattttaatgatagccttcctgttttacaaaaaatgcaggaaatttgcccgatttttatgcttcatacaaacggtatattttctgatatgaaaacatatttcggtatgagccagccggtctttatgatcatccttaatgttggattgatattcgtattttatagactaacaaaaaatatatcaaagaaacatcaagttacggggtaattttgatgaaagagacaagttgggttagttgtcctatatgccataataaaacccgaataaaaatacgaattgacacggaattaaggaatttccccttgttctgtccaaaatgtaaacaggaaacgctcattcatgtaaagcaactgaatatatccgttattagagagccagacgcatagacgcagagccgataacacgcaggctaacatgactgctgttatcggcttttcatattcttttaaacctgccccgcctaatggggaaagaaaaaaaccgtagctgggcaggttgattttgtgcgcttactctagataccctggcggcggttttgagaaatcagagccgccgtttcttttcgtctaccctaaaccaacgacgacccaacaccgtgtaaatccacggcggcatataggaggatgccgccgtgtctatgtttgcgtcttttcacagtatccatgatctgcaccacttaaaaaaagcctgttcccagcagcggagcaatgcggtcagaagtatgcactataccatgtaactaaacagcaaaatatactctattacgctcgtatggctttatgccgtccgggcgcttttttgtccctatggagccggaacatcgggtcagcatggcccgaactttatccccggtgccgctccccgccgcctcattcagatttaccaaaaaatctgaatggaggaaaggcagatggaagttaccatcaattataacggacaagctgtgaccgtggaggtcacgctggaagtctatgaatttcttgaccgcgccgatcacaagacggaaaaccttgcccatgaacagcggcggcattgggacgggcgggagtttgacgagtacatagcttttaccgagggcgtgggcgtttacagcgaaacgccggaggaatacctttgccgcatggaaacgctgcatgatctgatggctgttctggacacctgtaccgaggcccagcgccgccggttcctgctctatgcgcttgacgggctgagccttgcggagatcggtgtgctgtgcggctgctccaaagtagctgtttatcaaagtgtggaggcggtcagaaaaaaatttataaatttctttgagaacaggcttaacgaatgacctgttttctggctaccaagtgaaagggatcatttcccttatctcagcgaggggcggacagcggacgagctgtccgcctctccgattttcaggaggtaagcctatgaaaacaatcaatctgcggtggatgtatccccactaccggcatgacgagtttgtggatgttacggacgaggtatgggcagcgatgtatcaggcccagcgggagatggagaactatgagcgtcggaaagtctaccaccgcgcctactactctctggacgcatacagctggctggaaaattacgcactggaacacagcagatcgccggaagatattttgctggaacgagaagaaatgaccacccgcctgcacctgattgcagctctgcctgcggctctggctcatgccactccgacacaggcccgccgtgttcacgcctactacattgccggtatcaagcagccggaaatcgcccggagagagggtatccatagcagtaaggtcagcgttgccatccaccgggggctgcggaatatgcgccgctgctatgatgacctttttcaaacagagtgagggcgtgcctatgcagaccatcaatctcaaacaatattatccattttgcaaagaggacatttttgtggaggtgtccgatgagatcgtcgaagcgtttcttctggacaagagagccgaggccgccagagatcgcaagatgttccggtataaggcgttttattccctcgattgtaacgatggaatcgaaaatgccgccatcggctgggcgcagccatctccggaggactacctgatagaaaaagaagaattagccgaatatgaagaactgatacggcgattgtacgaagccatttcttccctgccgcctatgcaggctcgccgtgtccacgcccgctatatgctgggtatgaaagtgaaagatattgccgcaatggagggtatcacgccatcacaggcgggaaaatccatccacgctacactgcgaaggctgcgccggtactttgcgcgtcagaaatggacggtcaatctatgagtatttccaaagaaaagaggtgcatgacatgaacgaaaaaaatacagcccacccccaaaaagaagaacgggagaaagtcctgaaggagatccggcagcttgaaaaccgaaagaagattttggagaacaagcagcggaacgaagaacgcagggttcgcacccgccgtctgattgagcgcggagccattttggaggggatttttccgctggctcccaacctttccagcgcagaggtcaaagcatttctgattgccctgtcccatcttccgggggctgcggaattgactgcaaacctgccaaaatccggggacacgccataagtcccttgtttacaagggcgcacttatacaccgttgccggtgctgtgcgccctgccgggggcgttgcgtacttcgtccgcgatgggaagctacgctccccaaaccccttgtgcgctctgcgcagccaaacacccgctttgcgtttgtccggctccacagagcctgttatcccctcactgaaaggaggtgttccccatagatttctgtcatatccccgtcagtatcatcaagcgcagcgcgggccgttccgctgttgcctcagctgcttaccgcagcggaaccaagctgacaaatgaatgggacggcatgacccacgactacacccggaaaggcggcattgttcatgcggagatcatgctgcctgcccacgccccgccggaatttgcagaccgttctatcctctggaacagcgtggagcaaatcgagaaagcaagggacagccagcttgcccgcgagatcgaagcagccctgccccgtgaactatccggcgaacaacagcttgcccttgtgcgtgcctatgtgaaggacaactttgtagacaaaggaatgtgcgccgactttgccatccatgacaagggaaccggcaaccctcatgtccatatcatgctgacgctccggcctctgaaagaaaatggacagtggggcgcaaagtgccgcaaggcatacgatctggacgagaacggacagcgtatcccggatgggaaaggcggctggaaaaatcatcgggaggatacaaccgactggaacgataaaggaaatgtggagatttggcgggcagcgtgggcagcctacaccaaccgggcgctggaatctgccggtagaccggagcgcattgaccaccgcagctacaagcggcagggcattgataaaatcccctctgtccatctgggaccagccgccagccaaatggaaaagcgcggtatctgcaccgacaagggagaagtaaaccggcagatcgccgccgacaacaaactgttgaaagaaatcaaagcccgcattactcggctttatcgctggtcgaaagccgaagcggaaaaaccacaaacgcagcaaagcagcttgaccgccttgtgggaggcccagcagcagttgaacgctccccgcacccgcaccggaaaaatccgggctttgcaggaaagcgctgcactattcagctttttgcaggcaaacggcatccagtctatgcagcagcttcatgaaaaaatcgctgatatgaacagccgttactatgacctgcggggaaagatcgtcaaggctgagcgccggatcgccactcttaccgaacgcggggagatgtgggaacagtacaaccagtacaagtccatccacaaacagcttgccaaagtaaagccggaaaagcgggaacagtttgagcagcgccacagccgggaactgattctgtatgacgcagcgacccggtatctgaaagaactgaaagacaacggcgaggcaatcaccccgaaggcatggcagctggaaattgaccagctggccgctggaaagcagacggacacgcttgccatgaaatccatgcgggaggatttgaaagcagtggaacggctccgcaaaaccgccgagcagctgtcccgacaggaaagggacaagcctcacgaccgtgggccggagcggtaaaggctaccgcgttttggcgtacccctgtcaagtgcgtcgcatttcacgacatacttttgcacacagaaaaaccgccgtacaggtttccccatacggcggcagactgtttatttgccgaacaagtcgctgtgtgtgccggtgcgggccagcgtcagcaccagaacatcatcttctatgcggtagacaagcagccagtccgggagaatgtgacattcccgatggcctgcccaatcgccggacaggtcatggtcgcggttcttatccggcagcggttcgcccattgccagcaatgctacggcctgctccagcagttcgatcttcaagccacgcttgatggctcgtttgtagtcttttttgaaactggtcgtgtacttgacggtatatttggtttctttcatcttttcaggtcagcaaacaactcgtcaaggtcattgtagccctttacagacgggtcttttgcaatcctttccgcttccagcatggcagcaaccgtttctttgttcggctgttccagccttacttcaaagggaatgcctccttcacgaagcgactggcgcacaaagatgttaaacgccgtagtcagattcatgccaagttcagtaaacagtgcgtccgcttgcgctttcaaatctgcgtccatgcggatactgatgtttgtggtatttccagccatacgatcaacccctttctactggcaattatagtatatgccatttgcacgaagaaaacaatactttgcacgaatatttaacaataaattcattcaaggaggttacctgctttgtgaaagaaatcatttatgaagaacgacaagactgaacctatccccgtcatggattaccgccagtaccgcagagcgcggaggctggtgcatgagtgctgcaactacatcgacggaaattgtatcgccctggacgatggggaggaatgtgtctgtgtccagtctatttcctactccctgttgtgcaggtggtttcgggcggcagtattaccgcaggataaggaactggaaacggcgctgttccaccggctgaatgcgaagaaatgcgccgtatgcggggcgctgtttacccccggttccaaccgggccaaatactgcccggaatgtgccgcacgcatgaagcggatcaacgccgcaaagcgcaagcggaaacaacgggagaaatgtcacgctttaagggctgaaaaacccttgtaaatcaagggttttttcgagggtatcaaaggcaggctgatagatttatcctccgacccctaaaacggtcttaaaatgcgtacagaatcccaagagaaaccccaaggaggaaccctatgtcagacaaccgaaaatattattacctgaaacttaaagaaaactattttgacgatgattccatcgtgctgctggaaagtatgcaggatggtgtgctgtattccaacattctgctcaagctgtatctgaaatcgctgaaacatggtggacggcttcaacttgacgaggacattccttacacggcgcagatgatcgccaccattacccgccagcagatcggcactgtggagagagccttgcagatctttttgaagctgggtcttgtggaagtgctggacagcggcacattctacatgagcaacatcgaacttttaataggccagtcctctaccgaggccgagcgaaagcgggctgcaaggcttcaaaataaggctctttctgcgccccggacaaacggcggacatttgtccgacattcgtccaccagagatagagatagagttagagaaagagatagatataaagagagagatagagaagggacgctccgcccgcgcctatggccgttaccagaatgttttcctgacggacgaggaactggcagacttgcaggccagttttcctgttgtatgggaacagtacattgaaaagctgtccgagtacatggcttctaccggcaagcgttatcagagccatgcagcaaccatccggcgctgggccggtgaggacgctaaaaaaactgtcacaccctcacgcaaccgggattacagcgtaaaggaggatgaaactgtatgattgagattaccgcagaaatccgggcgttcatcgacaaggcagctgccggtgtggaattggctgaggacgagtatatagacccgtcagatgggctcattcactgtaagaaatgcggcggccagaggcagaccgttgtgccatgctttgggaaatctggctactttatgccgcgctgcatctgccagtgccagcgggaggctgaggagcagcgcaaggctgctgaagaacggcagcgccgcatggagcgtatcaaacgccgaaaggcacagggcttgcaagaccgttatctctatgactacacattttccaatgataacgggcaaaacccattgatggacaaggctcacgcctatgttgagaactggaaggaggcatataaaaacaacaccggcctgctgttgttcggggatgtgggaaccggcaagtcctttttcgccggttgtattgccaacgccctgcttgaccgggatgtgccggtgctgatgacgaacttccccaccatcctgaaccgcctgacggggatgttttccgaggacagggccgactttatcgccagctttgatgagtacgacctacttatcattgacgatctgggtgtagagcgcagtaccgaatatgctatggagcagatgtttttcgtcatcgacagccgctatcgcagccgcaggcccatgattatcacaacaaacttgaaactgtccgagctgaaaaacccgcctgatctggcccacgcccgtatctatgaccgtattttggaacggtgtgcgccgattctttttgacgggaagaatttcagggaagaaaatgccggtgctacccgacaggcagcaaaagacattgtaagcagtaagcacgactgattttttaccgggcggcacagacccgttcggagaaaggagcgccatgaacagagaaccccgtactatgcaggtggcagacgccgctactgcgtccagagcgccggaaaacacgccagcgatggtaaagaaaatcggtaagacaacctacaaggttcatgtccatttcagcaataccagcacagaaaccatgagcgataaaatcaagcgtatgctcaaaaatgaaattcagcagatgtgatagactgataaacgaagccaccttgtgctaaactgatgatggtacgcaccaaaatttttgtcaaggaggacacgaaaatgctttacacagaaaaagagaagcatgaaattgaacgagtaaaggaggtctttgcggaacatctgcggcaaagccctgattttgaactgctctggtcggacaaggtaggctatgtttggctggcgattggcgtaaatccgctttatgtggataccggtatcaggatagaatcagctgccgatctctgcggcaggtgtttggacgatgttgctacggatgttttgtatatgacgggcaacgatcatgcactggaagtagctgacccgctggaattagccgaaatcaagcggcgctgggagccatatatcaaccagctgccagactatgcgtatctctgcaaagacctgctgaacggaaaaatgtaatctatcaaacgaggtgtcaggagccatacggtgcttctggcaccttttttgtggatttttgtgaatttgatgaaaaagtccttgacaattcgtctctggaaagacagcaaaatccatattgattagctgtggtgcaagactggcaccttttgacattaaagagctgcgtgacctgatggaatatgacgagctggagcttgatacgattggtgagaaaaagacagcgttattcgtcattatttccgatacggatgccacatttaatttcgtggtgtcgattatgtattcccaactctttaacctgctttgtgacaaggcagatgatgtatataacgggagactcccggttcatgtgcgtatgctccttgatgagtttgcgaacatcgggcagattccacagtttgagaagctgattgctacaatccgtagccgtgaaatatcagcttctattattttgcagtcaaagtcccagctcaaggcgatttataaggacaacgctgacacgattgaaggcaactgtgataccacactattcctcggtgggaaggaaaagactacgctcaaagaactggcagaagttctggggaaggaaacgattgacctttacaatacctcggatacaagaggtacaagccagtcctacggtctgaattaccagaaaaccggaaaagagcttatgagtcaggatgagattgcggtcatggacggcggaaaatgtatcatgcagcttaggggcgtgagaccatttttctcagacaaatttgatataacgaagcacaaaagatacagggagctgttcgattatgaccctcaaaatgcctttgacattgagaaatatgtgaagcatctgcatcacatgaaagtcactccaaatacacaggtggatgaaacctttgactgtggggaggtaaacgggcaggaggagcattcctcaaatacaactgaataaagaaccatgaacctttggacacaatgtccagaagcaaaaataatttaagaaaagaaagaggtaaattgaatggcattttttacaacagcagtaacaggacttaaaacagtagtaaccgcaatcggtgcaggtgtggcagtatggggtgtgatcaatcttctggaaggttacggaaacgataatccgggcgcaaagagccaaggagtcaagcagcttatggcaggcggcggtattgttattgtggctcagacggtgattccacagcttacaagtctgttctcataattcatgggaacaatcattgacaaaatcactgaatttataaaggaaatgctgcaggggtgggtgcttgacaatcttgaaacgatgtttaccgacgtaaatacgaaggtaggctctattgcaggggaagtcgggcagacacccagctcatggaacgcaggcattttttccatgatccggaatctttcagataatgtcatgattcccatagcaggaatgattatcagcgccatactctgctatgagctgattacgatggtaatggataaaaacaacatgcacgagatggggagcgagttcttctttcgctacctcatcaaagcatgtgttgcggtaatgttgctcagtaagacgtttgacattacaatggcaatctttgatgtgggaaaccatatcgtgaccaatgcatcgggtgccattaccggctccacgagccttgatgtgtcatccacgttgcagaccatgtttaatgatcagctttccactatgggaataggcgaactgatagggcttggaattgaaaccatgattgtcagcttatgtatgaaaatcatgtccgttttaatcaccgtcgttttgtacggacgaatgatagagatatacctttatatttcagtggctccggttccgtttgcgacgctcagcaaccgggaatggggcagtatcggcaacaattacatcaagggactgtgtgctctggcatttcagggatttttcatcatggtgtgcgtaggcatttactctgtactggtgtcgagtgtggcggttgtatccaatcttcatacggcattatggtcagtggcagcctacaccgtcattttatgcttcagcttatttaagacaggctcccttgcaaaatcaatacttaatgcacattagtaggaaaggaaaatgcttatggcaatatcagtagcagtgccaaaagatttaagcggcatcaagacaaaggtggcgatgaatttgacaaaacgtcagttaatctgctttggtggtgcgggtgctgtgggtatccccttttatatttttacaaaaggggcaatcggcacacaggcatctgcattgctcatggtggcagtcatgctgccgtttttctttctggcaatgtatgaaaaggacggctttccggctgagaagattctgtactttatgatacggcagaaaatactgacaccgggaatacgtccctataaatccgaaaacatttacaggcagttggaggaacgggagaaaatagagaaggaggtgcgttatcttgaagaaaaagccgcaggcaaaacaacagggtaaacctgtaaaagcgggcttgaatttttcagaaaagaaaaggcttgcagagctgaaacgtactcttgcaggaaatgacaaaaagcaggaaaagccaaccacggcacagaatacgattacttttaaaaagatgttccgtgacggcatctgtcaggtgacttccacctattacacgaaaatgttggagttcttcgatatcaactatgaccttcttgagatagaggatcagggagagattctggaggagtacagtaaatttatcaattattttgacccgtctattaagttccagttatttctgtttaacagacaggtaaacgaacagactttaatagaccagtttgacattcctttgcagggagatgattttgatgatatccgggaggaatattcggagatgttaaagaagcaggctgcaaagggcaacaacggcatcattaaatcaaagtaccttatttttggtacggagtgcaagggctttaaagaagcaaaatcaaagctgaataatattgaagctgatgtgattaaaaattttttgaatcttggcacacacgcaagaagcctcgacggaaaggaaagactgcgtatcctgcatgaatatttcaaccaggatacaatggaacctttccgtttttcatttcaggaactgtcagagtctggaaagagtgtaaaggattatattgcaccgccgggctttgatttccgttatccgagccgttttaagacagggaagatgtacggctgtgtccactatctggatattattgcaccgaggtttaatgacgagttgttaaagaagctccttgacattgatgataacttaaccgttaccatgcacatgcagacaatggacccggtaaaggcaatcaagatgttaaaagcagctctgaccaatatccagaaaatgaagattgaggaacagaagaaagcagtacgttccggctatgacatggatattctgccaacggacattatcacttacgagaaggacacgctggagctgttggatgacctgaatacaagcaaccagaagattatcaagatgacctttcttattacctgttacggcagaaacaagagggagcttgaaaatctgattcagagagtatccggcattatccagcaggcaaactgcaatttgagatgtatgcagtatttgcaggagcagggccttatggcatctgcaccgattggctgtaatgatacgggtattgagagggtgcttaccacaaagagtactgctattctggtgccgttctgtacgcaggagttattcatgcctgccccggcaatttattatggactgaatgccttgtcaaacaacatgattatggcagacagaaaaaggcttcgtacaccgaatggagtcatacttggtacacccggttcgggtaaatcgttcagtgcaaagcgtgagattttatcctgctttttaatgacaagggatgatgtgattatctgtgatccggagggagagtattttgctcttgtgggagccttgcatggacaggtggtacgacttgccaccaattccaaagattacttaaacccgatggatatccagttaagtcataagaacgataaggaagcactgaaattaaagagtgattttatcattaccctctgtgatctgatcgccggaggaaaggatggtctggaaaatgatgaaaagggtattattgacgagtgtatccgtcatatctacgatgcttattttgaaaatccggtgccggagaacatgccaatccttgaagatttgtataatgcccttctggaacataagaacagcaaggcagaacgtattgccaatagccttgtgctgtatgtgcatggttctcaaaattattttaaccaccgtaccaatgtagatagtaagaaccgcattatgtgttttgacatcagggacttgggaaaccagttaaaagagcttggaatgttaatcgtgcaggatgcggtatggaacagggtatcgcagaacagggagagaaagattgctacccgctattactgtgatgagttccacctgctcttaaaggaaaggcagacagccatttattctgtggaaatctggaagcgtttcagaaagtggggcggtattccaacaggtctgacgcagaacgtgggtgactttctgaaatcagaggaaattgagggtattcttggtaactccgattttgtatacctgttaaaccagaacgcaaaggatcagacaatccttgtagataagctggggttgtcggaaaagcagcttgcccatgtgactaattcagagccgggttccggtcttatcctgtttgacaatgtggtaattccattcgtggataaatatccgacagataccaagacctatgcgattatgaataccaaaccggaggaaagtgtaaggcaggaggaaaataattagtggcagagaaaagaaagaaacagacggctgtgtttggcacaaatcagccgagagatgaaaacagagcttttggacacgatgtccagaggtcggaacagaaacaaaagtccggaaaaaataagcgaaagacaggtcagtaccggaaagaggatacctttggacagagagaccagaagtctggaaatacggataccagtaagaatcagaaaagtgatttttcacaggaaaataatgcttttactgaggagaatgtttccgagcaggagaaaagccagccacaggatgattaccaccgcagggatacttaccaccaatccgaaaaaaaggggaaatatcgtaggcgggaatatcaggacaggcagagaaccaggacttctgattttgagcatgactttcagacaaaggacagcacttttacggagagtgaaaggacagagtttgaaggaagtaaaaagttagacaggcttcagaaaaaggcagaaaaagccgggagaaaaacagaagcggcaagaaagaagattccgaagaaaacagaatattcccttgagcgtgtttttgatgaaaagacaggcagggcgaaatatgttctaactgcggataaaaaggaaaagcagtttaagccggacaatcccgtgaaagtaataacaggcagggcgggtgcagaggttttcaactttacgcatggcaaggtggctgaggtggaaaaagaaaattccggagtagagggcgcacacaagacggaacagaaagccgaggatgtgtaccattttgtaaaacggcaccataagagccgattgcagaaacagcatgagaaagtgaaaaagctggagaagaagcagtttcagaaagaggtcaaattccgttatcagaaataccttgaggaaaatccccaaatgcaggaaaagaccttaaaaaagcaaatacagaggcatttgcagaaacagcggatcaagagggagtatgcaaaagcaaggagggctggacaggcagcaaagaatacgaaggaagcggcagcaaatacagccagttttacaacaacagttgcaaaaaaggtgcaggaacttgcagcaaaacacgccggactgcttgttaccataggcatttttgctttactgctggttatgattatgatctgcatatcttcctgtggtgcaatgttttcggagggtatgagtaccacgatggcaggcagttacatgagtgttccggcagagattgatgcagcagatttagctttttctgagctggaaatggaattgcagaaagaaatcaatgccatagaaacagattatccggattatgatgaataccgctacaatctggatgctatcggacatgacccgtttgctctgattagttatttgtcggcagttcatacggaatttacagcggcagaggtacagagcgaggtggaaagcctgtttgatgagatgtatgagctgaccttaacgccaacaacggaaacaaggactcggacagtgacaaagacaggaaccaggactgtgacagacccggtaacaggagaagaaacagaggaagaatatgagtatgaggaggaagaagaatataccgtaaccatacttgatgtaacactgacagctgtggatttaaatgtggttgtggcaggacacatgaatgaggagcagaaggaaatttatgctctttataatgaaacacatggtcttgtccagcagttttatacaccacttgatttgtactggtacaactatgtgagcagctattatggctatcgtatcaatccggttaccggagaggagcagttccaccgtggtgtggacattgcagtaccgacaggtacgcaggttcttgcatctatggatggtactgttacaacagccacctatgatgcttcttacgggaattatgtggtgattgaaaaagatggttatacaaccaagtacgcacatatggacacgttaagtgtcagtacaggacaggttgtcacacatggaacggtcatcggaacaacaggaaataccggaagcagtacgggaagccatcttcatatcgagtgtctgtataacggggagtattataacccgttattttactttgaagccggggaaggaacactgtacggagaagcaccgggaagcggaagtggcggaggaaatgcaataccgccggattcttatgatgatgcaacggtgcaggcacttatggaagaagccgcaaaatacttgggctatccttatgtatggggcggttcgtccccgtcaacgagttttgactgttccggattcgtgtgctgggtgtttaccaacagtggtatccatgatctgccacgaaccacggcacagggcatttatgaccagtgtactcctgtttcggcggcagatgcaaaggcaggggatattatcttttttaccggtacttataattcaccgggtcctgtcagtcatgtaggtatctactgcggaaacggtgtgatgatacactgtggcgatccgattaagtatgcaaacatcaatacatcatactggcagagccatttttacagttttggaagattaaattaaccataggaagtgaggacaatgacaaaggaaagaattgaaaaggagcttacaaaagtccgggagcagcttgcgggactgcaggcaagacaaaaggacttggaggagcagttgcagatggcggaggatgcggagaagatgaaattcattgaaaaaaataaaatctctctggagcggctgattttactgaataaggtcagcgaggaggaaatccggcatctgttaaggaaaaaggaacaggaagaacagttacagaaatcagaaaagggggcagaatgccatgaagaaaaaaatgaagttatcttataaagcggtgttatcgcttatattatcagcagtattgttctgtatgcctgctgtgggctttgccatgaacggaaactatgctacggaggttcatgccgaagattccaccggagagaatgagacagcaacagagggcaacacagagcaggagacagaaagccctacggaaagcagtacagagcaggaaacggagagtacggtatcagggaatgatgtgccggagccggtatgtatctgtgaggataaatgcagttcttacgattatgaccatacctgtgaggtatgtgccggggattacaaaaaatgtgcttataaaaagcctaatgttaccataaacatcaacaaaccggatggctggtacaacgatactgcaaaagtcagcatttctgtatctgatgtggcacacacaggcaattttgagattgccagtatacaggcaaaaatcgggcagaatggaagctggatggatgtaactgaggacagaaaacttgagatttccgagaactgtaccgtatatgtgcttgtcacagaccagaagggcaatacctatgaaagatgcaggacaatcaaatgctttgatacgacaaaacctaccttaaatgcggcagtcagtgacggactgttaagcatacaggtacatgatacggattccggtgcaaaagcagtctatgtgaatggatatgaatttacagacctgacaaacggaaccttaaatatccgtctgcaacagtttgatgcgggatatgagtattttacgatttccgctatggacaatgccggaaatatgtctgaggtttacaagacaaagaatccatattataaagaccctgccgatgacagtgacgaaaatccggcagaacagcttccggtcagtgcggaagccaccaagccgggaaatgccacaggaacagttacagagcataccgttacagacagtaacggcaacactacttcacagaccagcctggcagatcagaaaaagcaggcgatggcagaagcggatgctgcagaaaagggtgaggatacaaaagcggagtccgggcagggcaaggaattttataccattcagactgcatcggataaagtgttttacctgattattgacaggaacggagaggaggaaatggtttatttccttacagaagtaacagaaaatgaccttctcaatacaacttccgataatagtgagactttaccgaaaaattcagcagcactggagtctgcaattccgacagaggagagcgcactgccaaacaataacagtggtgcagaaacagagcagaatgaggaaacagaagataccggggaaatggagaatacggaaagcacagaaaccgcagaaccggagcaggaggcggcagaggaaccgaatcctatggtttcctatgtgcttatgggtgttcttgcagtagcctttatcggtggagcatattattttaaggtagtacgcaagaaaaaagaggacttcatcgaggatgaagatgaggaagaagatgaagaatacgaaaacgaagaagaagcggaggaagtttccgaagatgatttctttgacgagaaggaggacgagtaaggatgcagttggtaatagcggaaaagcccagcgtggcacagtccattgcaggcgtaatcggggcgaatgagagaaaagacggatatatggagggaaacggatacattgtttcgtggtgtgtagggcatttggttgagttggcacagccggatgcctattttgatgcatggaaaaagtggagctatgagagtcttcccatgataccggaacaatggaagcatgaagtaaaaaaggatacagcagcacagtacagggtgttaaaggaactgatgcatgaagcgagagtggatagtgtggtgtgtgctaccgatgccggacgggagggagagcttatcttccgtctggtttatgaaatggcaggctgtaataagcccatgaagcgtctgtggatttcgtctatggaggaaagcgcaattcgggagggttttgcagaattgaaaccgggaagcgattatgatcatttgtatgaatcggcactttgcagacagcaggcagactggcttgtgggattgaacggtacaagactttttacggtgctttatggcggcaaggtcttgaaagtgggcagggtacagacacctacccttgccatgctggttgaccgagaaacaaagattatgaattttaagaaggaagcctattacatggcacacatcattggtggtggtgtggatgccgtcaccgataagataaacagtaaagcagaagcggagaatgttgcaaatatctgtgcaggtggtcaggcacttgtcacatcagtattaaaggaagaaaaatctgtggcaccgccaaagctctatgatcttaccacgcttcagagggatgccaaccgattatttgggttcaccgcaaagcaaacattggaatatacccagagcctttatgaaaagaagctttgtacctatccgagaacggacagccagtatttgtccgatgatatggagcagactgcaaaaagtgtgattgatgcaatttttgcttccattctatttgaacaaaatatcatatttcatccggatattaagcgtgtgttaaacagtaagaaggttacagaccacaatgccattatccccacaatggagataacaaaggcagatcttacggcattgccggaaacggaaatgaaaatcttatccctgtgtgctactcgtctgttgtgtgccaccggggaaaagcacatttacaacacaacaaaagcggagcttcgatgtggagatattacttttaaggtatccggaaaagaggttgtgagaaatggctggaaggactttgaggatgcgtttaagcgttcctatagaacaacagaggaaaaggatactgccgatgaaaatgagaagaagctgccggagctttccgaaggaatgaacattcctgtggaggaaacaaaggtaagtgaacatttcactgcaccaccgaaacactttacggatgtgatattttgtgagcgtaaggagtggataggaattgaagaaaggagttcagcatgagaagaaaaaaagatagaagcaatggcattactgctttgtatgaaagactgtctcgtgatgatgataatgctggagagagtaacagtatagttcatcaaaagcaaatgcttgaagattatgctatgaaacatggttttacgaatcttgttcattttaccgatgatggttggagtggagcgacctttgacagaccttcatggaacagacttgttgaaggtgttaaaaacggagaaatcactgcctgtatctgcaaagatatgtccagaatcggcagagaccatttgcaagtaggttttttcactgacattctgtttagagaaaaggaagttcgatttatagcaatcaataatggtattgacagtgaccgtcaagaaaccagtgagtttgccccttttctgaatatcatgaatgagtggtttgtcagggacacaagtaagaaaattaaagctgtactgaaatccagaggttcttccggcaacgctcatacaagtaatatcccaccatacggctatttgaaagaccccgaaaaccccgaccattggattattgatgaagaagctgctgaagtagtccgcagaatttatcgcatgactattgagggaaaaggaccttatcagatagcaagagaactttcagaagaaaaaattgaaagaccatcttattatcttggcaaaaagggacttggaaatcatgcaagcaactatgacaaagaaaatccgtatatgtggcgaggaaatcaggttactactctgattgcccgaccagagtatatcggaaagactgtcaatttcaggacattcaaaaattcctataaggacaaaaagacgaaaagggcagataaggaagattgggtggtttttgatgatacacaagagcctattgtcgatgaagaaacatggctgcttgctcaaaagttaagacagaatgtaagaaaagcagatcctatgggcgagcctaatgttctgaccggaaagatttactgtgctgattgtggtgcgccgatgtataatcacaggcagcggaaagggcgagaaagaatatactatactgccaaaggcgaaaaaaggacaagttattccaatccggcagattgttatgaatgttccacatataatcttgcttatcagaagtatgaccgacattgtacttgccaccatatttcaacaaaagcacttaaaagcatcattctgaaaaccatacaagagacttgccattatgtttctttgaatgagcaggagtttgtctattctctgcaagaagaatcggcgatgaaagatattgctgtttctgaaactgtaaaaaaacgcattgaaagaaatcagaagcgagttcacgaactggatatgctcatcaggaaaatctacgaggataatgtgattggaagattaccggacaggctttttcagagtatgcttactgattatgaaaatgagcagaacgagctaaacaagattattgagactgacaccgctgatatgcaacggattataggcggtcaaaataatgtggagcgttttctaaagctggttaaaaagtatgagaatattacagaacttactcctgccatgataaatgaatttatcgacaaaattctggttcacgagccacaaggaaaaggtgcagaccgcaccacagaggtggagatatatcttaactatgtcgggcaatttcaagtacctgtggagcagcatgaaccaacagaggaagaaaggattgctgctgaaaaagaggcggaacgacttcgcagaaaacgagaatccaatcgtaagtatatgaaaaagattcgtgagaaatcaaaagaatttgctgaacatgagcgtatagcagaagaaaataattttgatagcaatgtgcgtgtcgaacagaatgccgcaaccaaatcaaatcggcaaaaagtgaaaggagaaaaaatagcatgacagaattgaaaccacgaatccatgacaaaagcaacggtctggactatgttcttgtgggcgattactatgtgccggacttgaagccgccggaggaacaccgccctatcggtatgtggggcagactgcacaggacatatttggagcagtaccgccctacaaggttctctgccctctgtttatccggcgaactgcatacttaccttgctgacctgaacgaacaggcagcggaaaggtgcagccttatcattgagcagatgaaacaagccgagggcgtgaccgaaaccatgaaagcagacaatcagatgttgtgggtacagtccatgaactctatccgtaaccgagccgaagaaatcatcagacaggaaatgatttactgctgattttatcaagtccaaaaccaacaaatttgtatcgtaaacgaagcgacaggtatttccttatgaagtgtctgtcgcttttcatttatcaaactttaaggaggaaaacacaatgaagatgaaccggaatgaaatggaagccctttatgcctttggctgtccgaacctgaaagcaactgtcgagcgtttgcgtatggtagctgcccttgcacccgatccagtggcgaagaagctgttttatatgctttccgtcaagctgagtgctgagggtgttgaaaggtggtatcgctgcttttactgcaagctgcgtgtgttgaaaaaccatagggagggctgctatgacgagactgacgaagattgagaaagaaacaatcgttctctttaatgagggcgaggacaaggcaaatatctacacccacaacgccggattgaaaaagaggttggctgcttttgctaagaagtaccctgacctttgccgactggaaaaatccaatgttcaaggcggtgtttcttatgagctggcaaagtcccgtctgtctatccgtttcctgccgccttacagtgaggaacgcagacagaaagccagcgaatatgcgaaaaagcatgggctgaacagccagcagggataatgtgataatcagggctgatatgcggttaaaatgtcaggtgcagacctgatgttttgaccgttgcctatcgcctgtgaggaaagtatcggggactatggattttgccaaaatgtgcgttacaaggtttgaacaggaactctgtacacaaaattttttcttccattctttaggctgatgaagtataatagacaaaagataattttagaagtgagcttttcgggaggcagtatatatggaaaaaagtaaggtagaatttgtatataaaaatatttcttcattaaacaagataagtatagtgaataaaaaaatatttcgtattttgccatatatttgtgtgtcatcacttgttgtagggggaattgcggtttttctaaaagaaatgttgcctataaaaggagtgttgcctgattatattagacttgtttgcttagtcatatttttcttaacctttttgatgtggttggtgtctttcttttttgaatacattttcctgtttttatggaaatgccctgtatgtaaaggaaaatttccatggtataagactactttgggatatttaggagaagaaggaggtagtcttgtaaataaagaagttaaagatatttgtgaccgcaagaataagaaaatatctttaattcaatatgaaaatagcaatttaatcattcccaaaaagtgtccgcactgtggggaagttatatggaaaaaataatttttgtagattacctgtaatctgccacaactgaatatgaccgttaaggtcagatgaagaaaccgatgtattgagcgtaaagcgatcatgcgtcggtttttcttatttcatgagcagacagaattccgactgtatatcacccgtgaggaaagtatcggtgactatggattttgcataaatgcgcgttacaaggcttgaacaggaactctgcacacaaattttttcttccattcgttaagttgatgaagtataatgaaaaataagataaagttaattcttggaggtgttattcatgtttggttttaagaaaaatgaaaagccaacgctcattattgaagcaaaagatctaatggaaattatcaagtctgattatgataatgatatggcttttactcttattgagttttcctataatgagaaaaaatatgtgatgggttcctgtgttttacctgctaacgcagaggaatgtaaagaaaatatatcttttatatttcaagacagagtttttgaaagttttgaggaatttcaaactgctattattatagataataaaaacatcttacaattagaaaaaccccttgaaattttaagagcaggaattattgataatgagcctatgctgaaaacgccatggggagataaaagattagctgataaagctgttaataaatagcgtgtcgctttgaaaggagtacaaatttatggcattattgatgtttagaacttttggagtgattatagtatcatttatagtcttaattatgtatgttttgcatagaaagaaaaatgggaagtttataaaacgaaaggctgtcaatgaagaagaaaaaataaaatatcaaaaatgggaaaaaataatcaatgtgatggcagttgttgggttattgattctcggtatatttataactgttccttgttgcttggatataccttatttactatctaacaatttagttgaagttaccggagaagttacacaaggtgcaatgtcaggagaaaactctaatagtgaaagaagaatacatattagagatgagaaaactggagaagaacattcattaaaatattggggaacaggtagcgatttaggagataagataactgtaaggtatttaccacacacagaatatgggtatgtagttgaatagaataaaaataaatatcctattttgttttgggaaatttgtagattacctgtaatctgccacaactgaatatgaccgtcaaggtcagataaagaaaccgatgtattgagcgtaaagcgatcatgcgtcggtttttcttatttcatgagctgacagaattccgactgtatatcgcctgtgaggaaagtatcggagactatggattttgcggaaatgtgcgttataggtaagtaaaaaactacttgatagagcgtgaattgaattgttcatatcggtatgatataatttactgaaatgaagcaagaaggtggacttttgtatgaaaaaatttttgaaaatattgctaatcattgtaggaatagtttttttgatttttgcagcgctgatatgtattggactgtttgttgattatgatgaccatattgaaaatggtcgttatacttatgttccggaagatgacaataaagacaatgcatatgtcgaattcaatttgagtgattacgataaaaaggattctgaactcatatattatagttctgtcgaagaagctattttgaattctcctttgaatgctgaaaatgaagaattttctgttccagaagattttcttaatcatgttgatgaaatattgcatatatggaatggcaaacagtatgatactattttctatcgggtaggaagcgataacgatcccgttcaaggttttgtgatggcacgctgcaaaaaacaggtggaggaagcaagtgtacaatatgcatttatgaatgctacaccggttacaactaaagcggatagcattcttatatctgatattacagaactaattcgttcatctttaaaattaagtgattttcaacaggacttgaatccaaattatccagataccagatttgtttttggctatgcacatgataaggaaatttactcattagaagtagaaggtcaaaagccagatggtgttattgaaatcaatgtatatgacagaacgatgtatctatggtattatgatgatttaaagagcgacaagagaggaaacaatctaagttattcagtagatgtgccagagtaatttttcaaattggctaatctgccacaactgaatatgaccgtcaaggtcagatgaagaaaccgatgtattgagcgtaaagcgatcatgcgtcggtttttctttttgcaaaatagtccggtggactgttttgtaaaaccgaaggaactgacagagcttgggacggggcgaagtcagttcgttcgggcgggagtacagagggtgcaaccctttgtgcatgggtacagggaatgcaatacccctgtgcaggtcaagggcggcagccttgcccagttaagtggcgtctcgccacttagtactgggtattacttgacgcagaaagccgcatggaatcagcttcgctgcccttctcccctgtcggggaaatcaaaaagaaaaggaggaactcatgtgaaattaacaaggcacaatggacgagccggaaagaatggcgtttataatccgaagcacaatgaccgcagttttgacattgccaacagcgaacacattgacgaaaaacgagccaaacaaaatctctattgggactgttacaatggcttccgcaatttcaaaaatcccgaaaaggaaaatgagctgtctgccacttttgaagatgtggaacagcttttttatcgtcagcggtatcgtgattttgtgaccaggcagaacgaaagaaatgtgaagaaccgacaccctgaaagaaataaggaaaccggagatttactcaaaagcaaaaagacctgtccagaggaaacggtctatcagattggaacgcttgataatcatgttccgccggaattgctcattgagatcgtcacagaatttatggaaatcgtaaatgagcgtttcggctctcatgtccatatcctgaattgggcgctgcacttggatgaaagcacccctcatattcacgagcgtcatgtgttcgactgtgaaaatcaatatggggagattgccccacaacaggaaaaggctttggaggcactggggtttgaactgccggaaccggagaagccagtcggaagaaaaaacaaccgcaagatgactttcgattcagcttgccgagtgctgctgtttgatgtggcgaaaaagcatggcttgcaactggaagaagaaccggaatatggtggtcgtgcttatctggaaaaacaggactatattcttttcaagcaaaaggagcaactggcagcacaggagcaaaaattggaagaactcacgatgaagattgaggatgtggaagctctggtggatgaggttgccgatattgcctatgacaaggcggttgaggtcgttgctgatactgtgaaactggaaacgcacaaggaggatattaagctggtggagcagtctaaggcatgggttctctcccctgagcgtaaggcttcaaagaaagaagttgagtatgcagtgaaacgattggatggagtgattgccagaatcacaaacgctatgaaatcaaccattcagaaaattcaaaccacgctgatgaagccggaggtcaaaaaagccggaacggagcaaatcaagaagaaagccaaaagttccattatagagcagttgagccgcaaaaagaaagaaattgcagagcgtgaagtcagccgaacaattccggcgaaaaacaaaaagcaggatatggaactctaaggcacttgctgttttcattttgaaaatgacaggtgcttttgctttaggaagcaagaaaatatcttccattctttaggttgatgaagtataatgatagtaagaaattttttgtaatgaccttaatccaataagtgattttgcaattatcaagtaaaggatgtaattatatgaagaaagtactgttgcttttcagtgtgattattatactcggtttaacaggctgctctaacaaatatttcaatgactggtttagctctgaacaaaatgaaacggataagatgtgtcaacaaattatcgaggcatgtaagcaacaggattcagagaaactcaaatctctattttccgaagaaagcaaaaagaacattgagaatttagacactgaaatctctgcttttttcgattatattgagggcagtatccaaagttttgagggcgattgtgcatcatcaagtgaaagcaactatggtaaaaggaaaacggaattggatggtatgtatctcatattgacagagaaggaacggtattgtatgaatttttatatgtatagtgaggatgatgaaaatgcccaaaatgtggggatatataaaattgaaattgcattagagagcgaagtggctgaggataattttatatgggataatcccccaaacggtatttttgttggaggacaaaattgatttttgttatgagagaacattaaagtataaatttcggatggtataagaaaaactgactacaattaaatcttcacagctttactaagcaggaaatctgaaaaggtctcctgcttttttgcacccaaaattgaatatggaactttaagacacttgctattttcgttttgaaaatgacaggtgctttttttgtttcaggaaaggagtcacatgaatgtatttgaagttgtaaaagaaaatgttactgcccgacaagccgcagaagcctatggcttgaaagtgggtcgcacaggtatggcgtgctgtccgtttcactcggataagtcccccagtatgaagctggatgaacgctattactgttttggctgcggagtgaccggagacgctgttgatctcacagcgaagctattcggtatcgggctgagggaagctgctgtcaaacttgctgaagattttggtcttaactatgacagccgacaaaagccgagtattcgccctcgtattcgtgatccgacaccggagcagaaatatcaaaaagaagaaaatcattgctacaaggtgctgacagattattttcatcttcttagagaatgggaaaagaaatacgctcctaaacagccggatgaggaatggaatcccctgtttgcagaagcactgcataagaagaactatatcgaatatctgcttgatattcttctgtatggttcattggaggaacgaaaagcacttgtggcagaacagagaaaggaggtgttgaaacttgaacaacgaattgcagaactgtcagcagacagaaccatgtacagtagaagaaatccgaaacagcttagagcagagcgagaaaggtaaggtttataatactgccgcaaattataagcgtgttctgcaatatgacccacttttgaaaggggctatccgaaaaaatcttctgaccgaaagaatcgacattgtgaagtccctcggctggtatcgtgacagcccgacattgacggatgtggatgtgaaatatctgctcctatattttgaagaaaactatggattgaccgtagagaaaaaaatcatagacgcagttgcggttattgccaacgaaaaccgttaccaccctgtctgtgattttcttaatgccctgcaatgggacggaacggaacgcatacgcttctgtctgcaccgctttctcggttctgatacagatgattacacctatgaagcattgaagttgtttctgttgggtgctatctcacgagcttttaagccggggtgcaaatttgaggttatgctctgtcttgtgggcggtcagggagccggaaagtcctctttcttccgtttgcttgcggtcaatgatgactggttctctgatgacttgaaaaagctggatgatgaaaatgtgtatcgcaaaatgcaggggcattggattattgaaatgtcggaaatgattgcaaccgctaacgctaagagcattgaagaaatcaagtcctttctgagccgccaaaaggaaacctataagataccgtatgaaacacatccggcagacagaaaacgacaatgtgtgtttggaggttcttctaatactcttgactttcttccccttgaccgaacaggcaaccgccgcttcgttccggttatggtctatcctgaaagggctgaggttcatattttggcagatgaacaggcttcaagagcgtatatcaatcagatgtgggcagaagctatggagatttacagaagcggcaatttccgtctgagattcagtccggctatgaacgcttatctgaaagcccaccaaaaggattttatgccggaggacacaaaggcaggacagattttagactatttggaacgctattccggcagcatagtctgctctaagcagctttacaaggaagcactggggcatgattatgacgaaccgaaacaatgggagctgcgagagatcaacgacattatgaataacgctgtcacaggctggagggcgttcagcaatccgagatattttccagagccttaccgccgacaaaaaggctgggagcgtatcaggaatgacaacgagcctgacaacagcatggatggttttcaagaaatcccggcagaggaaatggaacagttaggacttccggaagaatggttgaagcaaaaataaaagcccgttgtcgcttcggttgtcggtctggttgtcgggcgaaaatcccgaaagccttgatattgcggcacttttccctctctgacaaccatgacaaccaatattataaagaaaaaggaaatagtaaaaagatagtatcgcccgataaagaaaaaaggttttctgatgtccgttgtcggaacttcgttgtcagacctttccttgtcgggcttttttcatttaattaggaggaatatcgtatgacaaatattgtgaacagtacactacctacccaaaataaccattcggagaaaaacaaaccggatggagtttttgtgattaagcaaggcaaaacaaattataaagtcaaagtgttttttgaccatagtagcggtttgactgctgaggacagattgaaacgcattattcaggcagaagcagagagagaatctgcgtaagtaatatgaaaaatatccacgcacccccttgacaaaagctttcagaagattctctgctctctgcaatggaactggccggagcagaggatatgggggatgatgtggagcgtaaaggtcttggcacacctgcaaccagagcagacattattgagaaattggtcaaagacggtttcgtgaagcgtgagaaaaagcagatgataccaacagaggacggcatgaagctgattacggtgcttcctgatgtggtaaagtccccgaaacttacagccgattgggaaaatgcccttacccttgtgtcaaagggcgaatattccatgcaggaatttatggatggtatcgagaacatggtgcgtgatctggtgcagacttaccacagcatcagcgaggaacagaagtccatgtttggagccggcacacaggaagcacttggcaaatgcccgaaatgtggtagcgaagtggtaaagggaaaattcggagcttactgtaagaataaatgcggcatgaatgttggcagggcaatgggagccgtactttccgacagtcagataaaaagtatgttggagggaaaaaagactcttgtaaaaggactgaaagggaagaaaggcagctatgatgcgtatcttatcccggaggggattgaagattattcctatatgaaagacgggaaggaaatcaaaggctcacagtataaggtcaagatggagtttccacagaggaagaaataaaatctggtagagggatagatgtgaaagtggtataatttctttgcataggtgctatgcacctatgcgtgaaaataagaatttgaagggaggagtatatatgtttaattttgatggatatacgaagttagtggtattcaaaaacatagaaaatcaacctatacaggaagttcatggacagaatatccctaaaagtgagagaaagtgtatcttttgtggtaatgaaaacgcaaaatttactaaggttgcacatgcagtttcagaaactattggaaataaatcacttatttcacattttgagtgcgatgaatgcaatcagaattttggtaaaatgtttgaagatgatttgggtaaatatatgcttccttataaattgttaacaaagacattcggaaaaaataatcaattatcttccaaagacatgccaaaagaagacggtatttcatatggaacttatcgcattcaattaaatagaaataaaccagttcttgaaaatattgacgtaaaagcgttaattattgaggcaaaaaatactggaattattaaattggataatgataaaattgaggtaaatattcctcgccagcattactttccaccgtcaatttattgttcttttttaaaaatggcatacagtataatgcctctaaatttatatcctcaatatgtaaaacatattgttgtattgcaacaactagtatcagcaagaagtatgtatcaaagtgtcgaactgaaaaaagagattatgcgttcaatggaaaattgcggactgttttgcttttttccagggcagaatccacttaaaggggtaaatgttacattgtggaaaagtttggattcaaaagagcaagaatatcctcgtgtgttatttacactagaaatgaaaaatttttcttttacaattccagtgtgtgcagatgatgaacagggaatttgtaaaatgcctagatttttaagtgatatggaaatgcaatatggaccattggatttgcaaaatgaagaaaagatatttaattgtgaaatgagtggagaaacaatagatattattgattataaattattagaggatgaattgagaaaaaacaatttgttgaaataacttaaatcagtcaaatcccagtttgtagcgctggaaggtatgaaagtgtaagggatataatatgtttttgattatagttgacttgatgatggcaacgagaggacggtgatgattgacatgaggctttgcattgcattgaccggtatagtttataaatcataataaaacatttggaaatatttggaggataaaatgactatatcggataaaaacatgaattataaaataatagataagcagacttattacaggagtggagtgttccggcatttttcggaagattgtaaatgttccacttctatgacggcaagaattaatgtgacagcactgaaaaagttttcggaagattctggtacgaagttttatattaattttctgtatgtactcgcaaaggtacttaattccagagaggattacagaatggggtatatttggcagaccgaagaactgatttgctatgaccagattaatcccgcacagtatatttttcacgaggatacggagacctgtacaccggtttataccgtttataatgtagactatcacgttttctataaggattgtgcagaggatatcagaaaagcgaaggagacaagagaatatcttcttgatatggcaaatcatccaaactggtttgatgcttcttacatttcatggttgtcttatgactcattgaatattgagcttccagacgggcatctattttttgcaccgattatcaactggggaaggtatcatgaagaaaacggacagtttttaatgccggtcagtgtgagactgaatcatgcaattgctgacgggtatctggttgcaaaggtatttaagctgctggaggatgagatgtcagcattttgtaatcagtataagaattaaaggtctaacttaccttaaaagagaaaaatcggaagtatagagaggaaatatggcatcgagtaaagattatttagaatttattttaggacagttatgcgagttaaacgatatatcatatagagcaatgatgggagaatttatactctattataagggcaagattgttggtggaatttatgatgacaggctactggtgaaaccagtaaaagcagcaatttcttatatgccaaatgctgagtatgaattgccgtacgatggggcaaaagagatgttgcttgtagatgatgttgacaataaggattacttgaccggattgtttgatgccatgtatgacgaattgccaaatccaaagcccaaaaagaagaggtagaacaacaatcccagcttgtcgagctgaaaaatttgaattcgtaggaggtatcgaaaaatgaataggaaaactttattctgttttctgacagctttgataatgatttttgttcttgcaggctgtggtggaaagaatagtggtgggaatattgacaatgttcaaattcctgattggaaaccatcggaaatatattcagacagtgatattgaggcggctttccaaacagtaaaagactatttcggcaacgaatttgacggctgcacactgacaaaactgtcctatcccggagatacatacgccgatgaattttatgaatgggctgaacaatatgacgcggatgaagcaatcgtaatattatcatctttcgatgtagactcatcaggcggggatggttcgcttaatccggattcaacatatgatgattggaaatggattctaattaggaatgacagtgggaattgggaacatgttgaccacgggtattaaagcgacagattccagttttatgttttttcataaaatccaattattactttcacatcactgataatttaatatcagacagcgttagagcatatagaaccaaaatctatatgctctatttttttacgcaaataaaaaacaggaggaaatctacatgaatgaagcagtagaaaacgtaacagaaaacacagaagtaaccagtaagcaggaggaaacgaaagcggagaaatttatccgtcttggagagtatcgcatgaataaggcgatggatgcgattggcagactggagcatcttgccaacaaatcagcttatgaatacacaccggagcaggtggaagccatgttctctacgctggagttacgggtggcagatgtaaaagcaaaatttacggtaacgaaaacaagggaaaatgcaactttttcctttgggacaaaggcagagtaggacgcataaggcggtgggtttctcaccgtcattttaggaggaaagtcgatgataacaaaataccagatgatctccataatggcggaggaaaccgccagagagattgcaaaaaatgaacaggcatggacaagatatctgaccacggctgcaaggttatacaaatatccttttaatgagcagatgttaatctatgctcaaagaccggatgcgtctgcctgtgcttctcttgaaacatggaatgagaaaatgaattgctgggtcaaccgtggagcaaagggtatcgcactcattgatacggagagtgaacgtcccagattaaaatatgtatttgatgtatcagatgttcataaagcaagaagaattgggcgtgacccttatctgtgggagtttcaggaggaacataaaaatgctgttatggaacagcttgaaaaaacttatggggaaacggacagcacactgccatttgaaagcaggataatagaactgtctgccaggattgccggagattattatgaggagcttcttccggaaatttcctatgtaaaagaagggagctttcttgaagatttagacgaatttaatgttggaatcaggcttcgggagatgttatccgcaagtatcgcatacacgcttttatcccgctgtggtgcggatatggagatatggaaggatgaacttgatttcagctatatcagtgatttcagcacaatggatacactttctgttctcggaaccgccactacggaaatgtgtaaaccagtgctgatggaaattggaagaaccattgcagcccatgatcgacaaagtgcccgaaataaggcaaaaaacaaggtaaatggggaacagtatgaaagccttgagaaaaacgcccaaaaagagcttgcaaatgagtctgaaccacgctataatgcgttaaagcgtgaaagcgagaacgaagcaaataaaatggaaacggaggaaacagcatatgaaactgacatacgagaagaacggggattatctgataccgaacctgataccaaacgaggagccgcaggggacacttacaaagtacggtctgatgaggaagaactttctgaaggaacacaggaaaggaatttattagggaatgatgctgaaaggaactctgaaagagcattgtctggagacacaggagcaggcagagcagaggatggaaatgctgaccggacagatggcgcagaaagagggagtgaacgaggaattgaaagcagccgatcagatgagctgggtagcgaagatgaacaacatcagacagtcagcggaggaaatcgtgctgaaggaactgatttacatttagacagcagaatagaacagaatgaggaacaactggagccggatagtggaagtaattcattatccggttcttttttggataatgcacaagaggaagattttactaacctaaaaaaaggtatcttgtgctttaataaacacctcattcataaaagaccggagatagcaggctatttccagatggagcaggatgcaagactccagacggactatctgaaaaattccttccgcatggaggagtttacagagctgtatataggagaaaccagggcagggtatcgtgccgatgaagatggacttaccatgtggaaagggaattatctcactcgtgaagaggaaacaagaatctcatgggaagatgccagatttcttgttaattcttatatagaggacggggtgtatcttcttccgggagaagtggcagagcagattgatacggatggaatgtataaacaacttgaccttttttccatgttttcggagcaggtaggaaatattgccatgaaacaggcagaggaaacaagtatagtgccaccttctactcaaataccgcaagagcagattgacacaatcctcagaagtggcggaggaaaggaaaacagcagaaaacgtatctatgccaagtatcagcagggaaagacgccggaagaaatggcggtttttcttcaaaaggaatacgctactaccggaaaaggttttgaatttgacggaaaacaggtatcggtatggtttgatgagcagggaatgagcatcggacatgggccatctgcgttggaatatcctgtggctaccatgagctggcaggaagtagaaaaggaaatacgttcacaggtggaaactggcacttacatgggagcaaatgaagcctatctcgtggatgaaagcgaacgtgatcgtcttgcaaatcatatttttttctttttccgtgatggtattggagaaatgccggaggagctggggctgaaacttagtaattatccggatgctcattccagactggtggaattattatccacgccggaaggagtggaacttgttgcatctgatatggataaagcattacagcagattgaaagcggagagaaggaatttcgttttcgttccataatatcaaaggaggagcttagagcagaacttgataatctgcttttggaaaagctaacctttcctactgctgataatgtggagattaagaaagaggattttatcacacaggatgagatagaccacaggcttggaaggggaagcgggtttgcacatggctctttccgaatctatgattattttaaggaggggcatgacagcaaggaggcagttgctttccttaaaaacgaatatggaacaggaggcagttctccggcactggctggaactgacagaagtaatgaaaatcatgatgcaaagggtatcaagttggagaaaggcagtatcatggagccttacacagaggtacttttatcatggaatgttgtagaaaggcgtatccggaaactgattgaggaggataggtatttatctccagaagggaaagaagcctatgctgtgtataaagaagatgaagccagaaaggctatgcagaaagcgcaggagaaaatggaacgtgacacaaaagtttcctgcaaagaagcaatagaaaaagcgattgcggagaagtttgacggataccgactgccaaaggaaactgcggaagatgttattcgtgaatatggaagcgaaagagttgcgtatgtgcttgccaatacggttatgcatcttagtcatgatggcagattttcgctggataacaaggaatgggcagaggaaatcgagccttatgccatgattgaaaatagggatttgattgtaagttcccaccctgccgtattaaacggatttatcaaccagacaagaagatatattgagcatgagaaggagcttgcagcacaggcggcagtggaaaatactattaccattgacggacagaactgcatacaggttgatgaatggaagtccggagaggacacttatcagcttggtaattccacagaggatagtgagttttattatgcagagataaatggaaatacccatatagaatatgatcataagccggaccgggcagagattgaggaagattatctgaacatcatggcagagagggatattgaccaccatgaagcagaagtttttgcacgatttgagggcagtgatgatagttcggaacaacttttggcggcagaagttgtgaaggacacttctggacaggatgtccaaaagtcagaaccacagattgacagatcaaatgcagtcaacttccgtattatggatgatgctcttggaattggcggggcaaaggaaaaatttagaaggaatgtggaagcaatccgtacgctggagcagatagaaagtgaaagccgtcttgcaacgccggaggaacaaaagattttatcacagtatgtcggttggggcggtttggcagatgcctttgatgaaagcaaaagtgcctgggcggtagaataccaggaattaaaagaactgttatcggatgcggagtatgcttccgcaagggagagtaccttaaatgcccactatacaagccctgtgattatccgtagtatttatgaagcgctggagaacatgggctttgaaaaaggaaatgttttagagccggcaatgggtatcggaaatttctttggtatgctgccggagaagatgcaggaaagccggctttatggagtggagcttgatgggattaccggaaggatagcaaagcagctttatccgaaagcggatattaaaatcacaggttttgaaaaaacagattatcccaatgacttttttgatgtggcagtgggtaacgtgccgttcggacagtataaggtggcagataagcagtatgataagaataacttcctgatccatgattatttttttgcaaagacgttggataaagtccgtcccggtggtgtggttgcctttgttacttctaaaggaactatggataagaaaagcccggaggtcagaaagtatcttgcacagagggcagagcttctcggtgcagtcaggcttcctaatacggcatttaaggaaaatgcaggaacagaagtcactgccgatattttatttttaaagaaacgtgaccgtgtgatggacttggagccggaatgggtgcatttgtcagaagatgcgaacgacattgccatgaacagttattttgtccaacatcctgagatgattgcaggaaaaatggaaatggtcagcgggccatatggtatggaaagtacctgtatgcccgataccacaagaccatttgcggagcagttaaaggaagcggtaagccgtatagatggggagatagaagccgtagaaatggatgaactggcagacgagcttgccgatgccactattccggcagacccggatgtaaagaattacagctatacgcttgtggacaataaggtatattaccgggaaaactccattatgaagcctgtggatatgccggaaaccatgcaggagcgtattaaggggatggtggatatccgtaaatgtacacaggaacttatcaatttgcagttggaagaatatcccgatagcgcaatcaaggaaaaacaggcagaactcaatacgctgtatgatgctttttccaagaaattcggtttaattaattcacagaccaacaagagagctttcaatcaggacagcagttattgcctgctgtgttctctggaaaagctggatgatgagggcaatttcaagggcaaggcagatatgttcacgaagcgaaccattaagaaagcggaagttgttacaagtgtggatacagcaagtgaagcactggcggtgtctttatcggaaaaggcaggaatagaccttgactatatggcaggtctgcttatggacaaagctgactatatggacagtgaaaaatatgataagatgcttggaaaaatcaaggaggagttaacaggcattatctttcaaaatcctgtgacggacagatgggaaactgcggatgagtatttaagcggaaatgtccgtgataagctggaaactgcaaaggtttatgccgagaaccacccggaatatgccgtaaacgtgcaggcacttacacaggtgcagccgaaagaactggatgcttccgagatcgaggtgcgtattggtgccacatggattgaaccgaaatatatcgaggatttcatgagggatacttttgaaacaccacatcatctgtttgaccggaacattgtgggtattcaatattccgatgtcaccggacaatggaacgtaaagggaaaaaatgcggattatggaaatgcccttgtaaacgtaacctatggaaccagccggagaaatgcgtaccagattttggaggattcccttaatctgaaggacagccgtgtgtatgacaccatagaggaggatggcaaggaaaagagagtcctgaataagaaggaaactaccatagcgagccagaaacaggaagccataagggaagcatttaaagactgggtatttcgagatccggaacgcaggcaggtacttgtggaaaaatataaccgtcttttcaattccaccagaccgagggaatatgatggttcacatctgaaattccccggtatgacaccggatattgagctgaagccccaccagaaaaatgcggtggcacatgtgctttacggggataatacactgcttgcccattgcgtgggagcaggaaagacttttgaaatgacagcagcggctatggagagtaagcggcttggattatgccagaaatcattatttgtcgtaccgaaccaccttacggagcagtgggcaagtgactttttacgattgtatcccggagcgaatatacttgcagctacaaagaaagattttgagcctgccaaccggaagaaattctgttccagaattgccaccggggattatgatgcggttattatcggtcattcgcagtttgagaaaatcccgctttcacaggaaagacagattgccattatagaacgccagattgatgagattgaacttgccattgagcaggcaaaagccgacaatggggaacgatataccattaagcagatggaaaaatcacggaagtctttgcagacaaggcttgagaaactgaacgatacatcaaggaaggacaacatggtaacttttgagcagcttggtgtggacaggctctttgtggacgagtcacataattataaaaatctgttcctttatacgaaaatgaggaatgtggcgggtatcgcacagtcggaagcacagaagtcctcggatatgtttgcaaagtgccagtaccttgacgagctgacaggtggaaaaggcgttacctttgcaacaggtactccgatttccaacagtatgacagagctttataccaatatgcgataccttcagtatggtacgctgcagaagctgggacttggtcattttgacagttggtcatcatcctttggcgaaacacagaccgccatagagcttgcaccggagggctatactttaataggacgataaaattaactgtcctaaattgaaaatacataaggaaggaggttaagagaatgtcaaggacttcaaagattacagcactttatgagagattatcaagagatgatgacctgaatggcgagagtaattccattaccaatcagaaaaaatacctcgaagattatgcccgtagaaatggctttgagaacatccgccattttactgacgatggtttttcgggtgtaaatttcaatcgcccaggctttcagtctttgataaaagaagttgaagcaggcaatgtcggaacattgattgttaaggatatgagccgattagggcgaaactatctgcaagtcggattttatacggaaattctgtttccgcagaaagatgtccgttttcttgcaatcaacaacagcattgacagcaacaatgcttcggataatgattttgctccgtttttgaatattatgaacgaattttatgccaaagacacgagcaataaaatcaaggctgtatttgatgcccgaatgaaagacggaaagcgttgtagcggttcaatcccatatggatataaccgattgccgagcgataagcagacgcttgttgttgaccctgtggcttctgaggtggtaaagcgtatctttctgcttgccaatgagggcaaaagtccacgagccatagcggaaatactgaccgaagaaaaggttttaattcctgccgcatatgcaaaggaatatcacccagaacagtacaacgggattaagtttgcagacccttatatttggggcatatctgccattagaacgattttaagcaggcaggaatatcttggacatactgttttgagaaagtcggtcagcaccaattttaaattgcataagagaaagactaccgatgaagatgagcagtatgtgttttataacacccacgagcctatcatatcgcaggaactttgggacagcgttcagaagcgaaagaaacgagtgaacagagctgcggcaagaggtacacataccaaccgattaagcggttatctgtactgtgccgactgtggcaggagaatgactttgcaaacgcattatagcaagaaagacggttctgttcagtattcttaccgttgcggcgggtatgcaagcagggttaattcctgtacttcccatacgattagtgctgataatgttgaagccttgatattatcggcagttaaacgcttttcaagatttgttctgaatgatgaaaaagcctttgctttggaactgcaatccctttggaaagataagcaagaggaaaagccgaagcacaatcaatcggagttgcaccgttttcagaagcgatacgatgaattgtctaaacttattcgtggcttgtatgaaaatcttgtttcgggattactgcccgaaagacagtataagcaactgatgaagcagtacgatgacgaacaggctgagctggaaacgaagattgaggaaatggaaaaggaacttaccgaagaaaaagtaaatgctgttgatattaagcatttcatttctttaattcgcaagtgcaaagagccgacagaaatttccgatttgatgtttgctgaactcattgacaagattgtggtttatgaagcagagggtgtgggaaaagcaaggacacaaaaggttgatatttacttcaactatgtcgggcaggtcgatattgcctatacagaagaagaacttgctgaaataaaggcacaggaagaacagattgagatggaacgcttggcaaaacagcgtgagcgtgaaaaagcctaccgagagaagcgaaaggcgaaaaaactcgctgaaaacggtggagaaatcgtcaagacaaagatatgtcctcactgtcaaaaagagtttgtgcctacaagtaaccgacagatattctgttcaaaagattgttgctatcaggcaaggcaggacaagacaaaagccgacagagaagctgaaaaaggaaatcattattatcgtcagcgtgtctgtgctgtgtgtggcagtacctactggcctacacacagtcagcagaaattctgttccgaagaatgtcaaaagataaaccataacgagaagtctttggaattttatcacaagaagcagaaggagaaatcagaatgcaaagatttattacagacgaaagaactggtatccagtacgaactcatcggagattattactatccctgcttgacgatagaaaacgaagaaccgcctacgctcacaaaatacggaagaatgagggaaagatatttgagggagcataggaaagtcttatattgcaatctgcttacaagcggaaagttatatgaacaccttgctgaaattgatacttcggcgtgtaatatggcggagtatctgataaaggaaatggcaagaaaacaaggtgtgacggaacaactgaaagcggaggatatgatgagatgggtcggattgatgaataatatccgagcctgtgcagatgagattgtattgaacgatattgtgtattcctaatagcataccagccgaaaaggaactgctgtctttactgatggcagttttctttttcgggaagtattcaagaagtcattaagtcgtgagtgtaatggaagtggttaaattgaaagttcataaagatggtatgatgtgttaaaatgagagtgatgaattgtaattttccgcattgaatattaagagacttgtaggtgtaagccttttgctgttttattatattctttcaaaaaatgaaagctaatctttgaataaatattttttgaatttaagtgacgcttgacacatttttcccgtttattagggtgaaaggccttaatacaagggaaaggaggagaagcctatggatgataagcagatattagatttatattgggagcgctccgaagctgctatatccgaaacttcaaaaaaatacggaaagtattgcagatacatagcctttaatattcttcacaatgacgaagatagcgaggaatgtgtaaatgatacttatttaagagcttggaacagcataccgcctaaccgtccatctgtcctaaaaacttttttagggaagattactcgcaacctatctttggacaggtacgaactgcttaatgcaaagaaacgtaatggtgggcaaatgccattggtttttgatgaaatacaagagtgcataccatcgttggatagtacagaaaacattgttgaagaaatcgctctaacggatattctcaaccgctttctttcttccctgtcattagaacagcgaaaaatctttatgagaagatattggtatttatcgcccattaaagaaattgcaacggaatatggtatgagcgagagcaaaatcaagatgtcattatttcgttcaaggaacgaactcaaaaaattgttagagaaagaaggtatctctgtatgaaagaaaagaaacttttaagggcattgggaaatgtcgataatcagtatattaaggaggctgaacctatgaaaaaaacaagtaaaataactaatcggcaaaaatgggtgtctgttgcagcttgcttcgtactcgttgctgtgattggagtgggagtttttcaaagcaatctgtttggtacaaaaaacgatattgccacgctgaatgatggagaaacaattacttttgttaaaaatgacttatcacaatcttcaattaacttaaatgtaacaacaagacctttgagcgatgctgaaattgaaatgctttttgcagacttgcctgttaccgcagatgcttattttgatgctgacaatcataatattctgggttttgagggaaaaattgatgatacaagaatggtagtttctaaacagggtgtaaatctattagatactatcattgatggaaatacaatcacttcaagtgtagacggcgttgatatcaacgcaggatatttcgtaacaaagtcaaatagtcaaggtgtcaaaaccgtaatatattatgcaacctttgatatgggagagaacactatttatgtagagtattctggcgttgaaaatgaaagtgaaactgtaaaaaacaacttggcagacacaattttgaagttgattgagaacggtgcatttgatttgagccaaatccaagaataatctgcaaatttcatatactaagaacttgatgtaacaccctatacccttaaaaaatagggaaagtaatataaagccccaaaaaacaagtctaaaaagttctattagaacggtatcttcgctttttgcctgttcttatgattataattttagtggtcacgttttttgctacttgaatgacagaaaacatcgtagaaatacggtgttttttgttgccccaaaccctacaatttcatacataaccacaggttagtacaaataccttgcgtgatttttttgaaaggcttagaaaggcaattttgcccgattttcgccccgaaaaatgacagaaacaaggctctgagtatctttcctgtggtttttttatttccagacggaaaggaggactttatgccgagaatgagcaagaaacggaaacaagattgggcattgtttctgaacgaaagaaatcgcattacctacaacgaactttgcagaaaatgcagtaatgactgcaagcagagtttccgttgtatcgtggtgctttgccctaagtatttatcgaaaaggagaacgaagaaaaatgaagcaaatggaaaatgaaatgaatgtaaatgtccctctcgaagttattaaggcaagtgagattgagccgaaggaagtgaaatggctgtggtatccgtatattccgtacggcaaggttacgctgttgcagggcgatccgggcgatggaaaaagcaagttaatgctgtcaatcgccgcactgctctctaagggcgaacctctgccttttactgaaacggaagaaaatgagcctatgactatcatctatcagacaacggaagatgatgcagacgatacggtagtaccccgatttaactctgccggtgggaacggagaaaaccttatcttcatcaaggaagatgaaaagtctttatcctttggagataaccgtattgctgaagcaatcgaaaagtatcacgcaaaacttttaattcttgacccgatgagttcctatatcggagagaactgttcaatgaacaatgccaacgaaacacgagcagagtttaatcacttgatatcagtcgcaaagaatactggctgtgccattgtgattatcgctcatatgaacaagatgagagataccaaccctctttatcgtaccaacggttctattgatattgcgggtgctgcaagaagtattcttgcgatcactcgcacaccgaacaaagaagcaccagcagaaagatatatggtgcaagtgaaatctaaccttgccccgacaggctcggcaattctttttgaggttgccgagaaaggcgtggactttatttctgaaatggaaatgacagcagaagaagcgttccagtcccttgcccctaaaatgggcagaccgaacgacaaggaaatcaaggcgaaagaatttcttttagaaatgctgaaagacggagaaatgctttcttcggattgcgaagaaagacttgaagccgcagggttcaagaaatcgaccatcaaaaaggcaaagaagaaagcaggagttatctccaaaaagaaaggctttctgtggtactggtctttgccgatgggcgatataccgagagaatgaaagcaggctgtctgatggtgggacagtctgtttttatgattgaggtatcaaaaggaggtcaagggggaacacccttgcccacgacatctttgcagacgaagtctgaaagtgtcatagtgggttacacacattcaaagaatgttgtgtaatggcttcgccctgccgagaaaggagaacgaaaatggcaaaaaacaacaaggcggatatgagttgtgcaagggtaaaacagtatgccgcttctgatgtgagcaaggcggaaaggcacaacgaacgcaagaatgaaacctatgaaaatatgaatgtgattgcggaacgaataccttttaatgtgcatttcaaaaagccgactgccccgacctatatggaacagttaaagcagatggaaacagacggtcaggtgtcgcttcgtgggttgaggaaagacgcaacgctgtttgatgagattgtgattgatgtgaacacgatgtacttcgagcgtaatggtggttatgaatacgcaaaacagttttatgaagaagcctaccatttcattgaagaaaaattcggtgctgacaatgttatatcggcagtaatgcacgctgatgaaatcaatgtggcagcaagcgaggaacttggaaaagagatttaccattatcatcttcacgctatggttctgcctgtggtggagaaagaaatcctatggagcaagcgttgtaaagacgaaaagttgcgaggaacagttaaggaagtagtcaatcagataagccattcaaagaaatggaaatcggatattccaatgaccgatgaaaaaggaaatccgttgttaaggaagaatggtaagccgatgtttcgtgcttcgtacagcatactgcaagatgagctgtttaactatatgacggaacaagggttcaaaggctttcagcgtggcgaatacggaagtacagccgagcatttgacttccctgcaatatcaaatccaacaggacaaagagcgattggagaagttgcagaagcgtattcaaaaggaacaggttaagtatgagcctgcccgtcatatctccaaaaccttaaacgagattgacagtatgggacagaaaacaatcacaggcaaaatggcaatctccaaagaagattattcccaactgactgcccttgccaaagagggtattaccagtcgtggggaaattaagaacttggagcagagtgcaagttattaccgacagaaatatatggacagtgcaaacgcactggaaagaatgaaaaccaaatacaacgaactgaaagaaaagtgcagaccttttcttgaagcgttggagcatttccccgaagttgccaaactttttaccgagaaagtgaagcaacttttttcttttaaggaagcacaggaacgagccgaaaaagaagcaagggaaaaagaaagacaggagcgtatcaaggcacgaaagagcaagcgaggtatggaaagataaccttttccattatactcacgacttaatgacttcttgatatgttccgatgaaacaggctgtatttgtggggtgttccaaacggaatgccccacaatcaatttatgaaaaggagaaaatgattatatgaaagagaatactttatcttatacaacacgaataggcaaaacaacttttattgtaaatgtgaagcaatcggaaagtgcgaagaagcctttgaatacggtgtttcaagagctatgcagacacgagatgttaggagatttttcagcggataaatatttgaatttagaaaacttacaaaaatcatcttgacaaactcgttcccgagggaaccggataccgggcaaagacgaggtttgcgaaattcttcaacctgccggagctgatttcgctttttaaggagagtgcagatattcagacgccggatatgttaaaattgcctgtgccggaggcagagtatgaaaacgtggtgctaaagccgagtgaataccagcaggatatggtggcgtcgcttgcggaacgtgcggaggcagtgcgtgacaggagagtggacgcagcggttgacaacatgctcaagattaccaacgatgggagaaagttagcgttagaccagcggcttatcaatgatatgcttccggataacgaaaattcaaaagcgaccacatgtgtcgaaaaagcatttgaaatatgggagcagacaaaggagcagaagtccacgcagcttattttctgcgatttgtcaacgccgaagggagatggcacttttaatgtatatgaggatatcaaaaagaaactgatggaaaagggcgtgccggagaatgaaattgcctttatccatgatgcaaatacggagcttaggaaagcggagctgttcggaaaagtaagaagcggacaggttcgctttttacttggttccacgcagaaaatgggagccggaaccaacgtgcaggacagactcatcgcattacatcatctggatgtaccgtggcgtccttctgatgtaggacggattttgcggacattcaaaataaaaaagaatgtggaggtaacagacaatggcaaaatcattatttgaggaactgggcggcaaatacgaaaggcaaggggattatttgataccgtgcttaactgtacccgccgaagaagaacaggcaataggcatctgggggcaacggcatttagattatctaaaacagtaccgtaaagttacatacaccaatcttcttacaagcggcaggctaaacgcctaccttgccgacatcaacagacaggcacaggaacgctttgaaaggctcatagagggtatgaaacaggcacagggcataacggaacagctaaaggcagaaaacgccttagaatggacaggatgcctcaataacataagggcttgtgcgagggagattgtggaaaaggaaattatttttgcataaacagatgattagtggcagggggaaatcctgccgctttttctgctttagtttgtcagcttgacaaataaagggttaaggaatataattagattcagtattatacaaggagttaataaatatgcggcaaggtattcttaaataaactgtcaatttgatagtgggaacaaaaagtagcagtctcgtttcacttttaatatggggcttagttttttgtacccagtttaagaatacttttatcatgtaattttatatgcccgaaaacatataagtgttttggggctattggagttatttacccagtgataggagtatttatcactgggtatttttatgcccttttttgggtgttgataggaggaaaatcacatgaaaataattaacttaggcattctggctcacgttgacgcaggaaagacaacattaacggaaagtttattgtataccagtggtgcaattgcagaactagggagcgtagatgaaggcacaacaaggacagatacaatgaatttggagcgtcaaaggggaatcactatccagacagcagtgacatcttttcagtgggaggatgtaaaagtcaacattatagatacgccaggccatatggattttttggcggaagtataccgttctttatccgtattagacggagcagtattattagtttctgcaaaggatggcatacaggcacagacccgtatactgtttcatgcactacagacaatgaagattccgacaatttttttcatcaataaaattgaccaagaggggattgatttgccaatggtatatcgagaaatgaaagcaaagctttcttcggaaattatagtgaagcaaaaggttgggcagcatccccatataaatgtaacggacaatgacgatatggaacagtgggatgcggtaattatgggaaacgatgaactattagagaaatatatgtcagggaaaccgtttaaaatgtcagaactggaacaggaagaaaacaggagattccaaaacggaacgttatttcccgtttatcacggaagcgctaaaaacaatctggggattcggcagcttatagaagtgattgccagtaaattttattcatcaacgcctgaaggtcaatctgaactatgcgggcaggtttttaagattgaatattcagagaaaaggcggcgttttgtttatgtgcgtatatatagcggaacattgcatttgagggatgttattagaatatctgaaaaagagaaaataaaaatcacagagatgtgtgttccgacaaacggtgaattatattcatccgatacagcctgctctggtgatattgtaattttaccaaatgatgttttgcagctaaacagtattttggggaacggaatactgttgccgcagagaaaatttattgaaaatcctctccctatgctccaaacaacgattgcagtaaagaaatctgaacagcgggaaatattgcttggggcacttacagaaatttcagatggcgaccctcttttaaaatattatgtggatactacaacgcatgagattatactttcttttttggggaaagtgcagatggaagtcatttgtgccatccttgaggaaaaatatcatgtggaggcagaaataaaagagcctactgttatatatatggaaagaccgcttagaaaagcagaatataccatccacatagaagtcccgccaaatcctttctgggcttctgtcgggttgtccatagagccgctccctattggaagcggagtgcagtatgaaagcagagtttcacttggatatttaaatcaatcgttccaaaatgcggttatggagggggttctttatggctgcgagcaggggctgtatggatggaaagtgacagactgtaaaatctgttttgaatatggattgtattatagtcctgtaagtacccccgcagactttcggctgctttcccctatcgtattggagcaggctttaaaaaaagcagggacagaactattagagccatatctccactttgaaatttatgcaccgcaggaatatctctcacgggcgtatcatgatgctccaaggtattgtgcagatattgtaagtactcagataaagaatgacgaggtcattctgaaaggagaaatccctgctagatgtattcaagaatacaggaacgatttaacttatttcacaaatgggcagggagtctgcttgacagagttaaaaggataccagccagctattggtaaatttatttgccaaccccgccgcccgaatagccgtatagataaggttcggcatatgttccacaagttagcttaacagcttgcaaaagtcatataaaatgagatttgaaaggattagagactaattatgatgaaatgcgaatggatattgtgtcctgtttgtgggaacaaaacccgtaataaaattaggaaggacactgttttggagaattatcccctttattgtccaaaatgcagacaagaaagattgattaaagttgacaacttgaagataactgtcatcaaagagccagacgcttaagacgcagagccgatgaaattgtggaacaattcacgaatcatcggctctttttgtttcgtatttgaaagaacaaactcaccaaataaaaaaaacgatattcgggtgggttattttgttataccctaaattaccctctgaatttgtttttaaatttggagggatttttttatgtccttttttcgggcagttatctatctgctcatacgaagcaaaatttatcaatacatagcatatcagagaacggcaggaaaccagttaaaaaaatttctgcctatgcaacggcacttcctgccttgaatgtagaagtacaatctccatacaacagaattaatatttcccataaccgtaaaggtcatagagcctttgcggtttttcttttgtcgatttttgttggaaagtgccatagggctattagtggtgttaggtgtcgttcgccacctctccatctggattttgaacatttcaaaaattcagatgggaggtacttacagtgaaatacgcaccgagaaaggtatatatcaaggaaagcggcagatatgtggaactgtcctatacggatttctgccgccgcagggaatccgaccagacctatatggacaagctgtttatccccattcaaggctgtctgcttgaagtcgtgagggagcaatacacggacttctaccgagataaggaacggtggcgttatctgaaaaaattagatacgaagaacagcctgctttctctggatggatttacggacagcgaggggaagcctttagactttatcgctgatgaagcggcagacattgcggaaaccgttgtcaatgcggttatggtggacaggctgaaagccgccctgcctttgctgtcggatagtgaacaggaattgatacaggcaatcttttttgacggactttctgagcgtgaagtcggggcgaggttcggcataacccagagcgttgtgaacaaacgcaaagccagaatcctaagaaaactaagaaagataatagaaaattaaaatttaaggcgttcagcccccttgttttttcctttgggaaaatgagggggtttttctctgccctctcaatcaattctgattggaggaaaagaagcatggcatataaccacggacgggaggacaggaaatggcgtatctggaaagaagcggaggaaaagctgctgcgtgagtgcggcgttgatgaagcgaccattgagcagatacgcattgcggacagggcagacttcaattccaacaggcggttttaccgatggacgaatgacattgcggaataccttgaggacatggcagacagggagcggcagacggaagtgggtacggttgcggagttactggacgagattgagagcgaaaatctctatcaagtattagtcgcggtggacgggcgtaccttgaaaatcgtcctgctgaaaatgcaggggtattccacaaaggagattgccccgctcgtgcatttgacgactggtgccatctatgcgaggttagaccatctgcggaagaagctacgaaaattttatagcgtctaaaacagcctgccgtcctgcgggctactgggtgagggatggaaatcccctcacttattttttgcaggaggcaagcgggatggcatacagagttaaggcgtacacgcttcgggaggaatccacggaaagcggcacaaggtattttatcagctttaaggacgggcagggcaaatcccacgagttggaagtgtcggaacagttctttatggagtttcggcagatggaacgcaggaacaggaatctcctccaatgggacgagcggcacagggagttttcggaagtatgggacgaaacgctgaacaggcgggcgttgaagctgcctaagagcatagaggaacaaatgattgaggcagaacgggcagaactgctctgtaaggcggttgacggactgccagagatacaaaggcggcgtttcctgctctactacgagtatgagttcaatttttaccaaatcgccgctatggagcattgcaccgcttcggcaatacagaaatctgttgcgattgcaaaggagaaagtaaaggcggaaatgaggaagtatctccaaccgtgaccgacaccgcccgaaaaagaaatctgttttttatttgtgtgggattggcggcattacatactctcactttttcttcgtgggagtaaatctatttttaaggaggtcaacgcctatgtgcaacgaaaacaaaaacaccgcccgaaaggaggaaagccatgcagaagttacagacagtcaacgccgaaacgctcctttatgaaccgcttgagaagccgtcctttgtggtggacagccttatccccacaggcttgtcgctgttctgcggctcacagaagataggaaagagctggctcatgctgaagctatgtttatgcgtgtcgcagggacttcccttgtgggatatgccgacaatggagggcgacgtgctttacctctgccttgaggacacgttctgccgtatacaggacaggctgttccgattgacgaacgaagcgagcaggcggcttcactttgccgtggcaagctgcaagctgtcagacggtcttatcgtgcagcttgaagattatctgaaagattacccaaacagcaggcttattgtcattgacactttgcagaaagtccgtacagcttcaaaagacaatgcctacgcaagcgactatggggacatctcactaatcaaagactttgccgacaggcattcattggcggtcattgtcgtacaccacatccgaaagcagaatgacagcgatgtgttcaacaaggtgtctgggacgacaggcttaacggggagtgcggacgctacctttgttctggaaaaggagaaacgggcatccgacaccgccaagctgtatgtgacgggcagggacacgccctatcaggaatacacgctgcgtttccgtgattgcagttgggaacttgtggagagaaaaacgcaggagcagcttgcgaaagaaacgataccagacgtcctttttcggttggtggattttatgagggataaggaagaatgggcaggcacggcaacggagctgttagccgctatgagggaaacggaaaccatacccacggtgattacgaaatggctcaatgaataccgcaccacatttttaaatgagaaccatatcgtttatcagtacagccgcaaaaaacacggcaggcagatttcgcttgcaaagcgggcgggtgacagcggtgacggtggtgacagcgatattgggataccccctgttactgtcattgacgcttaaagccgtgtaaagctggcgactctgccctgcgggtgacagcggtgacggcggtgacagtgattttaggataccctgccgctgtcatccctgcgggagaacaccccgtaaacgcaaagtgcaggcgtaggatttacccgcccttttcggcgtgtaaaaccacccctgcggtcagaaaaatccttccgatttttccgactgcgtttacagggtgtaacacactacactttgccctgcaaagtcgtgtgccagacgttccctctggactcccttatggcaggtcttacgccctgcttatcctacgctccacgcttcggataaaagaatggcagcatgacggtgacggctcttgcgagggggtattccaaaaacaccgtcatcatcgacatgaccgtcatgcagggaataagggtgacagttgaggcagtcggtagggggtatcccaaaactgctgtcaccgccgtcaccgctgtcacccaaagggcagtttacccgccgaagaaaggaagatgatgaattatgccctatgcaatcctgcgtttccagaaacgcaaagcgggcggcgttgcggcttgcgaacgccacaacgagcgtaaaaaagaagcctataaaagcaatccagatatagatatggaacgctcgaaagataactaccatcttgtgaatccgccgaggtacacctacaagaaagagattaaccgcatggtagccgaagcagggtgcaggacgaggaaagatagcgtgatgatggtggaaacgcttatcacggcttcgccagaatttatgaacagcctgccgcccaaagaacagaaagcgtattttacgatggctctggatttcatttcagagcgtgtcggggagaaaaatatcctctccgcagtcgtccacatggacgagagaacgccgcatatgcacctctgttttgtgccgattacaccagacaataagctgtctgccaaaacaattttaggcaatcaaaagagcctgtccgaatggcagaccgcctaccatgagcggatgtcctcacggtggaatcagcttgaaagaggtcagtcctcaatggaaacgaagcggaaacatgtccccacatggctctataagttgggcggcaggcttgataaacagtatgaggaaattgtgtctgcactgtccgacatcaacgcctttaatgcagggaagaagcgtgacaaggctctggaactgattgcggcatggctcccagacgtggagaaattctcaaaggaaatcagtaagcagagtgcctatatcaatagcctaaaggagcaaatcgggcaggaatcagactatgcggggcgtatgcgtgatgaaaagtatgagcaggaactaaaggtgcagaaagcgaaccagaagatatttgagttgcagagaaccaacgagcagatggggcggctgctctcaaagataccgcccgaagtgttggaagaattgcagaaaaaccataaaagcagagcgaaagaaaggtagatatgtgaatgaagaaacaggattttaaggtgttaaagaccaaagacttgtacccgtttcccgacaatccgtttcatgtggcagaggatgaaacgctgtcagaattagcggaaagcatcaaggaatttggcattgtcacgccgataatcacacgcccgaaagaggacgggaacggctatgaagtgattgcagggcagcggcgtgtccgtgcgtctgaacttgcagggataaataccgtgcctgcgtttgtcctgcccttagaccgtgaccgagccatcatcacccttgtagacagtaatttacagcgtgagaatatcctgccatcagagcgggcgtttgcctacaagatgaaatccgaagccatgaagcggcagggtttccgcacagacttaacctcgtcacaagttgtgacgaagttgcggacggacgacaaggtggcacagggcttcggcgtaggcaggatgaccgtacaaagatttatccgtttgacggaactgataccgccgattttgcggatggtggacgaggggaaaatcgccctcacgcctgcggtggaactgtcctttttgaagaaagacgagcaggaaaacctctttgccacgatggagagcgaagaagcaacgccctcactctcacaggcacagcggatgaaaagcctaagccagagcgggcggcttgacatggatacgatatttgcaattatgacggaggaaaagggaaaccagaaagaaaccttgaaaatcaacacaagcaagctgaaaaagtattttccgaagaacacaacgccgaagcagatggaggaaaccatcattaaacttttggagcgtgaattgcagaggaaacggggcagggacagccgctaatcttctcttttcgggaggtaaatgcagaaaattgaggtatgaagaatgaaagaaatccagtatgagattgtaaaggaaatcgccgtattgtctaagggcgacagcggctacacaaaagaaatcaatcttatctcatggaacggaagagagccgaaatatgacatccgcagcttttccccgaaccgtgagaagtgcggaaagggtatcacgttgaacgctgatgaagcagcagcactccttgaagcattacagaaagaagtaaacagcggggattgatggtatctgattgacagggcggggcgtttccagacgttctcctgccctgtctggaaaggaagatttaagtatgggcgaggataagaaagcagataaaaagagaaagcgtatcgtgccgaaagcaccagttcagatgataatcagccgtgaatatgtcggcacgcagacagtcacagaagcgtttatcccgattatttccgaggatattcggaagaagattgccgagggcgacaccttcgacaatgaggggctgtccgcttagaatgtacgcaatggaacatgaaaacagataggacagatatggaggttttacagtatggcaggaataagaatggagaacaagatttatgaagtcggcatgtactgccgcttgtcaaaagacgatggcacggataacgagagtgcgagcattgcgacacagaaatccatcctcacggattatgtgaaaaagcagggatggcacttagcaaaaacgtatgtggacgacggttactctggtacaaatttccaaagaccaagtttccagaacatgattaaggacattgaaagcggtctgataaactgcgttatcacgaaagatttatctcgtctggggaggaactatcttgattgcggactgtatctggaagtgtttttcccagagcataatgtgaggtatatagcggtcaatgacggcgtggacacgctcaataaatccgctatggacatcacgcctttccgcaacatcctaaacgaaatgtattccgccgatgtgtcggtcaagataaaatcggcgtaccgagcgaggtttcagcaggggaaattcatggggacgacagcaccatacggttacgtcaaagaccccgccgaccacaaccatctgctgatagatgacaaagttgcccatgtggtaagggaaatatttgaccttgcgttagcgggcaacggaatcgccaaaatccgcaagcacatcaacaaacagcatatcttacgccccgccgcttatgcggcggagcagggggcaacaggctatgagaggtattttgaggagaatgaggagaaccgttatatttggagcgagaacagcgtaaggggcattttaagaagcccgatatatgcgggaaaccttgcaggctacaagcggattgccgccaacatgaaaagcaagaaacgcccctctaagctgcccgaagaatgggaagtgataccagacacccatgaggggatagtcacgcaggaggaatttgataccgtacagcagcttattacaagccgcagattaccagaaaacaagggcggctttgagaacatctttgcaggcgttattaagtgtgcggactgcggctatgcgatgcgggctatgagtgccaacaggaggaaacgccccgacatcatcgactgcgtacaatattcctgcaataattatggcagatacggtaatatcatgtgtaccgcacacagcattgaagcgagggacttgttcaacgctgtcctcaccgacatcaaccgatttgcggatatggcagtcaatgatgaaaaggcagtgagggcgattgaaaagcggctcacggaaacagaccagagcaaggcaaaggcactggaaaaggagcaaagaaaactgaacaaacgccttgcagaactggacaggctgttttcctcactctatgaagataaggtgatggagcgtattaccgagcggaattttgagatgatgtcgggaaaataccagaaagaacagcttgaaattgaagcaaggctgaaagaggtaacggaaacgctcagcgacagctatgagaagacgcagggtgtccgtgatttcctctccctaatccgcaactatcaaggcattaaggaactggacgcaaccatcataaacgcacttatagacaagatacttgtttcggaacgtgagaaacttacagacggaatggtgcggcaggaaatcaagatttattataaattcatcggctttgtcggtgaattacatatcacaccgacaaagcggtggactgcgttaaagcctaagaattgtacggtgtgcggtgttgaatatgttccccgctctggcatatcgaagtattgtcctgcttgtgccaagaagatacagagggagaaatcaaacgagagcaaacgcaggagcagggagcgaaacagacaggcatgtattgaactgtccgcaaaaaatgaccgactgacatagaacagcaggaggggcgtattttaaggcagggaaaccttaatccgaaagtaaagattttccggtatgtgacggaaggaaccttcgattcgtacagttggcagcttatcgagaacaagcagaaatttatcggtcagatcatgacaagcaaatctccggtacgaagctgtgaggatgtggatgaagcggcacttacctatgcagaggtcaaagcacttgcaacggggaatccctacatcaaggaaaagatggacctggatatacaggtatcgaagctgaagctgatgaaggcaaaccatacaagccagaagtacagattggaggacaacatcacaaagcactacccacaacagataactattttaaaggaacgtatcagtggtatgcaggcggatattcagactgcaaaggaaaatcttccggcagataaagagcagtttaccatgaaagtcggggataagctctacacagataaaaaagaagccggaactgctcttgtggaaatgtgcaaagagataaagagtgtcaatgccccggcaatgataggcgagtatgcaggctttaaaatgtctgtatcctttgattcttttaatcacaaatttgtaatgaatgtcaaaggacagttatctcataatttggaaataggttctgatccgcttggtaatatcgcccgtatcaatcatgcactggagtccatgccaaaagagcttgcagaagcaaagaccaaactggacaatgtggagcaccagcttgaaacggcaaaggtggaagtgcagaaaccttttgcacaggaagaggagctggcagaaaaattagaccgtctgtctgccttaaatgccctactgaatatggatgaaaagggagatgatgggattggtatggatgatgatgcatcggaacagaacacttccggacaggatgtcaaccaatctgcacagcagaatggtttgaagccggagagaaaggagagtgttgcggataagccactgacaagggtgtcattaaaggaaaggttggaagtgatgaaagaaagagttttagttggtggggttgataaaacagtacatcagaaagaaaagggagttgttttataaaaagggctatttctttttgaagttatatgaaatataatagtatttcaaagatgtaaattgaaaagaaaaatatatggatatactgtaaatatctgagaataaaaataacattgaatttgtcagacactgtctgacaaattcagaaaggatatactatgaacgatttagaacaaacggatatgcttcaggtgctggttaatgagattgccgatactgtttctaacgcaaaaagagaattggcagaaaaagtaaatagtgtgatgacagaaacttattggacaatcggaaaatacattgttgaatttgagcaggatggtaatgtgaaagcagaatacggctcccgattattgacgaagctctcacaccagttgacattgcgattagggaaaggttatagccgtcctaaccttaataacatgcgtaaattttatctgtgttatccaaattgtcagacggtgtctgacaaattaacatggtcgcatatttgcgaactgataaaaattgatgatgaacttgaaagaagtttttatgaaaaagaatgttataaggaaaagtgggatgtaagaactctcaggagacagatggattcagcattgtttctaagactggctgcgagcagggacaaagagggtgtattagcacttgccaatgagggaattacttacaataagccggaagatattgttaaggatacttatacattggaatttttaggtattccggagcaggaacgatatagcgaagaagatttagaacagaaaattattgataacctgcaaagttttctgttggaattgggtaaggggtttacctttgttggcagacagtatccattgacaatcaataatatacattatcatgtggatttggtattttatcacagaattttgaaatgttttgttttaatagatttgaagaaaaattctgtgcagcatgccgatgttgggcagatgaatatgtatatgggatattttgcaaaagaagaaaatatggaagatgataatccacccataggaatcatacttagtcataataaagatgaattacttgtagaatatgcaacttatggtatggatagtaatttattcgtttcaaaatatgaattgtatttgccagatcgtagggaactgcagaaattattgaatcatattatggaacaggatataaaagaaaaagaggaatagtgtaaaaatgatacgggacatttaggtgaatcgtatttcaatttaatacagaacagtgaaaaagacaatcagaaatggttgtcttttttgtatgcaaagaaaggaaaaagcattatggcagatgaaagaacagaaaagcaaaaagtaaaagaaatcacagacaagctggaggaaggattaaaggaactttttgagagtgaaaaatacaagtcctatctttccactatgtccaagtttcacaattacagttttaacaacactcttctgattgcgatgcagaagccggaagcaacgcttgtagccggatacaaggcatggcagaggaattttgaaaggcatgtgaataagggagagaaagcaatccgtattcttgctcctgcgccatataaaatcaaggaggagagggacaagattgaccctgtgaccggggaaatgacctttgatgagaatggtatgccacagaaagaggaagtagaagttaccattccggcattccgtgcagtatccgtttttgatgtatcgcagacggatggtaagcccataccggagttggaagcacaggagctgttatctacggtggaggggtatgaggactttgtaaatgccctgatgtttgtatctccggttccgattggttttgaggatatccccggtgattccaaaggatatttccatacagaggaaaagcagattgccatacaggagaacatgagcgaaagtcagactttaaagacaatggtgcatgaggtagcacattccatgctgcataataaagaagtaaatcaggatattttggctcctgcaaaggacagaaataccaaagaggtggaagcggagagtgttgcctatacagtatgccagcactttggaatagatacttcggattattcgtttggatatattgcaggatggagcagtgggaaagatatgaaagaactgaaatcttctcttgatatcatacgccatacggcttcagaactgatcaccggcattgaaacacagcttcaggaattgcagctcaaccgggaaatggaacaggcacagagtaaggaaagtcttttgctgatacagaatgatgctctgacagagttcagcttaatcaatgtccgtggaatggacaggcaggagcttatagaagtgctttctgcaatgaatgaggatgataaattaagtattccggcatatctggaaagcaaaggagcctggactacggaacttgggaatggacagtcagaggaagtggaggagtaccaccttgatgtcagatacaataccgatacagacgagataaaggatatgaaggctgaaatggaactggataaaagagcaaaggagcctatcggagcagcacagcttttatatggtaacacagataaatacggcatttatcagttgaaggataacccggagttaagacagttccgatttgagggtacagaaagtctgaaaagaatggggattacaaaggataattttgatgccattaaaatggaaaattataacctgatttatgtgggagaattatccgagttgcagggaccgacacagggggaaacactggaagcggtttatgaaaaattcaatatagaccacccggcagattataagggacattctctttcagttagtgatattgtggtgctgcatcaggacggagagaatacggcacattttgttgattcctttggttttactaccttgccggagttcttaaaggagcagacacaagcgttagaagttgcaccggaagatgtgcgggaaacttctagacatgatgtccaaaagtcggagctggaagaaatgcaggatatggaaaacggagatgaaatcattgatcttggagatgaaaaggaacaggtacttgcggaaatgaagcagtccctaaaaggagaacaggaaacagagcttgcatttcagatagcagaccgtttcatcagcatacaggaggtggatggtggttatgagtattctattataggaactgactataaagaaattgacggagggggatataacaatccggaagtgactattcgggaagcacttcatgatatagtggatgatctgaaatcagaaccagatcacaatggtgcaaagggaaatatcagtaaggatgatgaactgataccgattgattatgatggattgatggaaaaggtggaggaagccaatcgtattcgtcaggagaacacgcaaagcagtgtggtggctgattttaaggcaaagaccggggaattattccacgatattagtgaaatgaatccggaagaaatcgaggaagctgtgaaatgccatgtgcaggcgaagattgaagagtatgatattaatgcaacaatcgaggatgttgctgtaacaggaagcagatgcaggggattagagcatgaaggttctgaccttgatgtggtggtggaactttccacagcggaacgggaggacgatttatttaatgcctttaatgaggatggacttcatatcggagaagtaaaagttgacatcaatccaattacagcccaacgcacaggtacgctggaatcctatctgccacaggtggaagaatatttggagggcgtcagacaggtaagagagcaggaaaaggagagcgcagaagtaactttaactgtttcggaatgtggagaatttcataatcttggtgagtgttatgagaatattactacggtggatgaagctatagcaatctggaagcagataccttcagagcggatgaatggtattccggcaatcggaatcaatatcctagggagaggggcggaacccttcgagtattacgagattgatgttttatctggaaagaggattgacctttgggttttggactatgttcctgatattaaaaacaatccgcaggcaatggaagtcattacggaactggtggctaaattgcccgatatggagatagatggcgtgatgagtgaagaaatggaagcaagagtgtgggaactgcgtatgccggacttgccacaggaggaacagcttgcagtagaacttgaccgacttttctacgattatgatactgtactgtatcacgatagtacaagaaatatgaccgagaatgtatcagaacttgcagaatccataaaacagggcgataccggacatttaacaacgtggcttgcagacattatttcggagggagctgtaccagaggaaataaaacgagcaacggagcttctggaaaaactgacagagtataagccgcttgccaagattgaggaggcagaagaacagaattataatatgattgataatgtgctgaataatggtgttggggagaaagcccaaagggaagaaaataagagaatggaggagaagcctccagcaagagtttccttaaaagttcgtcttgcagagaaaaaggcacaggtagaagggaaatcgaaagaacatgatgttcaggaaaatgaaaagaaaagtcatagggagatgtaagtgatgaataagagatttaccgtagaagaaagtaatttaatcagtatttttatggaagaaggtatagattcagatgtgggcggcagaaaaaaggtcataaatggtattgataaagcactgaaatatctggaggatgatgagatggttgaattgtcattatgtgtccttgtaaaattaaaggaattgacggatcatgaatttatgaagatggagtttgtagcggcagagtaacatcaaacgtaaggcagagcatggcttttggaggctgtgttctgtctttttgaataagaacttgactgataaatattacgggtgtaatatttataacgaaaggaattaaatttttttaccctaaaatcttacacttgtaatatataagcgtagtacattgatacgaataagaaatggaggtaacgatgaaggaaaaacatagaaccaaaagaatacaaagatatagaaaaatgttgagcattatagtgttgatattaacaattactttgattggagtagttgtgagtgcaacagtattatataaaagaaaaaattcgtgtaaaacaccagatactatcttagtagagtatatgatgcatattccaaaacaagaatacgaagaaatgtatgcaatgattgatttagagtcatctggatatatcagtaaggaagattttctgaagagaaattccactatttatgagggaattgaaatgcaaaacatgtcgataaaaaatgtcgagtatgtggaggaagataaaaaagtaacatatttgacttcgtttgatacagtggcaggaactatcagctttgagaatgaggcattttttataaatggagaagaaggatataaattggtttgggatgattccatgatttttcctaatctgacttctgcagataaagtaagagtttctactacacaggcagagcgaggagaaattctggataggaacggacgtgtccttgcaggaaaaggtacagcatcttcagttggaattgttccgggcaagttggaaaacagagaggaagcaatcgcacagattgcaggactattggaaatcacaacggaagtgatagaaaagaatctgtctgcaaagtgggtaaaggatgattcttttgtacctattaaaacgattccaagagtggaagaaattgagttaatgtctatcagtccagaggaagaagttttaaaggagaaagaaaggcatgataagttgctggagattcccggagtgatgatatctgatgttgaagtgcgtgaatacccattaggggaagccgctgcgcatttggtcgggtatgttcaaagcgttactgcggaagatttagaggaacatgcaggagaaggttatacagccaatagtgtaatcggcagaagcggaatggagggcttgttcgagaaagaactgaaaggccagaacggttgcaggatttacattgtaaattcggaagataaagagaaggaggaactggcttgtatcctggtacagcatgggcaggacatccggcttacgatagatactgatttgcaggtttccttgtacgaacagtttaaggaagataaaagctgctcagtagccataaatcattataccggagaggtattggctttggtcagcacaccggcctatgacaataacgattttattatgggattatcgagtgagcagtggactgtacttaacgaggatgagaataagccaatgtataatcggttccggcaagtgtggtgtccgggatctaccttcaagccaattatagctgcgattggtttacaatcaggagcaatcgatccaatggaagattacgggaacgtaggattaagttggcaaaaagatgcatcgtggggttcatatcatgtaacaacgcttcatgcgtatgaaccagtcattttagagaatgccttgatttattctgataatatttatttcgcaaaagcagcattaaagattggatcggatgagttggagaattctttgatacggcttggtttcaatgaggaactaccatttgagattaagatggcagaatctcagtattccaatacagaaggcattgaaactgaaatacagttagctgacagcggttacggacaaggacagattttagtgaacccgttgcatatggcatgtatttattctgctttctgtaatgagggaaatgtaataaagccttatttggtatatcagaatgaagcggaagctgagtattggattccgggtgccttttctaacgagacagcaagtcgtgtattggaaggaacaaagaaggttgtgaatgattctaatggaactggatatgcagcccatcgagatgacattcttttagcaggaaaaacaggtacggcagaaataaaggcatcgaaggatgatacttcaggtacagaattaggatggtttgcaatttttacagcagaagatacggaatgtcctatattgattatcagtatggtagaagatgtgaaaggaagaggaggaagcggatatgttgttaagaaagacagtctggttctggaagagtggtttagcagtcattagttttgtactgatgtttagtatttcggggtgtagcgatacaccaccggaagaagatacagtttcggaaacagtaattgatgttcaggacgtttcagaagaagaacaggagaatgaagaagaaattataaacatctgcatagatctttatgacaaggcagcagaggaaaataagttagatgatttggaaataattcggagtattgtaaatcgtcttggagaaaacgagtatcctgctgttgacagcagaaatcaagtgaatatgacggaagcggagcaggtactggaattttgtgaaaaggtggatgcacaggaagaagcagatataacgattcttgaagtcggctatttgggcggatttgtaaaatacgatttgcacacaaaagacggaaatgtagatgtggtcagaagctattatggatacgaaaatggagaaatacagaaagaagttactgggaggtatcaagcagagtattggaattatacagaagaaggttacctgatgttttctggtgtctggttttcagaagaattatacgttcttacattgagtggagcagaggagcataccgcattacgagtacagccattggatgaaacatatagggaactgagtcggaaatatcttcttccaatcagctttgaacagaataatatgtttattgtggattggagtgaagaagattttggggatttgaatttctatgatatgtatgacattctttatccaaaagtgaatggtcagtatgttccttatgttgcagatgacaatttgtcagtcagtgcagtttatcggattccaaaagaggaatttgaaagcgttattatgaaatatttcaatattgatagtgaaacgctgcaatccaaaactgtctatgattcggaggattcgacctatgaatacaaaccgagaggcttcgaagaagtagagtatccggaatacccatattcagaagtaatcgggtatacggagaacagtgatggaacaattacacttactgctaatgtggtatttccatattcgggaaattccaaagtatatgcccacgaggttgtggttcgtcctttggaggatggcggggtacaatatgtatccaatcgaattataccctccgaggataattctgaggaaacatggcatacgccacggttgacgttagaagaatgggaagaattatacggagacgaataatggaagatgtgaaatggctgcttagaagatgtggtcttccgattttgctgctgttgattttcgtaatagccggagtggtctgttggggagaactgcatacagaaaagcaaaaggtggcagaagaagtatgggagccacctgtagaaatcgaaaatagcgaagcagaaacagaagaagccgagaatgcggaaacttccacagagtcagcatattggtttattccgcaagccagtgatgatctccttacagaagaggagaaggagcaactgcagagtacggttttgtcagcagcagaatcggtcagagaaatctataaggatattgtaattgcagatgcactaagctactcttccggtattagcgaatttaccaaagagcagaggaaagctgtggtggagcaattgggcagaaccggtctggtaagtgttgaagaagatgctgctatgcaaaatcatgaagcaatcgaagcattttatgcagattacctggatggacaagactcgatggttacggtatttgaagtacagagagatgggctgattggagcagttacctttatctatcggaaaggtgagttgcagacctattacataggaattcggtggagagaaggtggtatgccagaaatacagggaacttcggtaagtaatgtggctgagattaaactgaccgaaaaaggatattttatctacgcatatgaatatgtgattgcacatgcaagtttgagacagtattggagaatagaaccgctaccagaagactgccaggaattaacggagaaatacatatcaggactaagttatgtgaattacaatctgctcgttacagattgggatagcagcaatgtggaggacattctgatgccttgtatgtatgaagatgtttataggatttctacgggggaaaatctgaaaactgagggttggaagattccggcagaggaatatgaaaggataatgactacttattttccggtatcggtagaacagttgagagagcattgtggatatgatgagggcagcaatagctatgaatatgagatgatttatgccagtccatacccacctttcggagaagtagttgactatacaaaaaatgcggatggaacgattacacttatcgtggatggagtatggccggattataattctgatctcgcttttcggaatacggttgtggtccagccatttgaagacggaactttcaggtatctttccaattctatagaacaaatagagttggaactgccgccaatagcaaaagcacattaaatttgctttgaaagaaaggatgatattatggcattaaagaaaaaaagcattttgctgattatggcatttctgattggatgcttcgtatgtgcctgtggaaaagaagatagtattgtggatgaatttcttgtggaagatacggaagatgtatcttccacggaggagataaaaagtgccgaggaagaggctgcagaacaatgggaaaagggctacgaccttccagtagatgaacaggaaagggaagaagctgagactgactgtaaaaagcagatggaactttatcttgacatttatgaaactgcagataaagggatagcatctaatgttgctttggatgatcaaacggttttggaaatgcagaggaagctaaaggatgcaggatgtccggttacaacaatggtaacatattctaacatggagaattatgaaagtgttgacagttttctgaaagaatgtatggaagggaaaagtggttctgcagtaatttatgaagttcacaacgatggtggattgggcagaatgaaattcatttttgatggaacagatatgtatgttgtaagtgcaaaaggaatctggaatgctgataataagccggggatttcatacatttcctatacaagactaaaagagtggaaatatacagataagggatggttctgctacgagttgtgtgtaccggagccaccagaggtcagtgagattatggatggaagttgtctaataaggataaagccaatgacagaggaacagcgtgaaatgtctgaaaaatgcgtgcgtggtttgggatatcagggaaataacctcttatgttccaattgggatacagagcatatggaagaactggattataatgggatgtatgaatatctgtatgcaatgaaataccaggaaaagtttaattctgagaattacccaaatggaataccaaaagaggaatttgaaaatttaattatggagtatcttccggtgacggcagagcagatacgggaatatgcggtgtttgatgagaaaaaccaaacgtattattgggcgcgacttggatgctttaattatgcaccgactttctttggaacttctctgccggaggttatcgacatcaaagaaaatgaggatgggacaatcacattaacagttgaggcggtttgcgacatggtcatttgtgatgatgcagtcataacccatgaacttacggtaaggtttgcagaggatggcagttttcagtatttggggaatgaaatcctaaatgacggaattatgcacataccagactaccaatatcgaattaaagaatgatttgataatagttgtgttttgtggtaatcttacatgcgtaagaaaagaaaggaggacacatgaaaaaattaaaagtagttggaatattggcagcagttgtattaataggaggagttgtttcaattccgcttataaataaccatacagcctataaggtggaaaagacattatgtgaaattccgctgccagaggaaacggaattgatagagtcactgtcacaagcagggaagctgacaggaaacggaaatggaatgcagtatttcggagcaattctaattcgaagtgacttgtctttggaagaattggatgcttactattcaaggtacagaagtaatgagtgggaatgtttggtgaaaattcaggaagggcagtccattgaggggattgatcacgggacactacaatttgcggaagaaataaaggacaggggttattacattgtatattcttggggaagtggaaattctctattggatgaattggatatacgtggacactaaaaaggagcaagatgaattatgaaatatatttccaaaatcagtaaaatcagtagcttcatattttacatatttctattgtgccaattatggcatttatgccaatatggaatcattagaagtcattttttcggagtagttatttgtacagtaggttttacagcggcagttattgtttggttggtttcaagaaggaagaagttagaagaggatacggagaggataattaacgattgggggattcctttttgaataggaatctcttaacgcatttaagggaaggatggagtaaaaatgattataaagtctattatgaccgatgaagatagaaaagcattagagtatatgctttcgttagaatatgctatgccatatcaattacttaagacaaaaaataatagaaggaaaattatttatataatgacaccagtattatttttgttatcaatcggttgctattttgtaaagagttatccgatgttttatgtgggaatggggatttctattattgcattgatttggattatttggtttcaatctaagggaaaaaaatttgaaaataatgtccatgaatttgtatggaataaatcaagatataacaaagtggaaattgatgttcagggaataaaattagaagataaaaagatctgcgaacttaaagaaatagatagagtctttttgtacaaaggttttttctttctcataacgaatgaaaagaagttacttgtactaaaaacagtaggtgtagagacagaagaacttattaagattattaaagaagctgatatcttatttgaaaaaagagaagaaccatttaatatttatgaatattgcaaaaagtagtaattaaaaaaagaaaaaacatttaatatttataagcctcgaaaaaacgagtaaaagttaattctacagttaacctttactcgtttttgttatttctgtgatacccagatattcatgtctgataagatagacatggttatttcagttgcgttgccgccagtagcatcgctgtctgcactaatgttggtggcaaaaaagtatgtattatctgcagtttcgatataaccgatgaaccatccattaatatcctgaccatttacacgtccggttccggtctttccgtagaatgttccggcatcggaagctgaaaggcagatggcatcttttactgcattgatattttcaggggcgaagccgaaactgttattctgcagcttggttaaaagttcgacctgttctattggagagatttccaaggaggattccatccaataagaggagaaatcgccactcatgttttcgttaccatatccgatttcttgaacatagctgtaaacgtcagaggctccaagctgttcatctactgcttgaaaataccaattcacagaggagttcattgcagactgtaaggtctgatctgcgttccatgcttcaaatggataggtttctccattccatgcaatgaacgaattttccggtgtaatgacgccttcttccaatccgaacaaagcatcgtatatcttgtaggtggagtttggagcaacccgtaaggtggcatgctccatgtcatgtatactccatgcatcgttttccaaatcgtataaaacaaagctgccttcgtattctccgaagtatgtggagaggtctacataggaaatattctcagaagaggaatcccattggtagtggcttccatctgctgcgtatgtagaaataaaaggtgcgaatccaaggagaaggacagcagtcaacatgaatgcagtcataccttttactctttttataaatgtcggcttctcataagatacaatgttgataattctccgtttcatctgcttcatgtttccaccaagaccggcggcaaacggaaatggagtaagtgaaatcttttccgcaaaattgatcagtgtattaccataatctgcataatcatcctcctcaagcatctttaaaacagaggtgtcacaggcaacctctctgtcattgcgcatttcttttagagcataccagacaagaggattgaaccaatatattactccggcaaagttcattagatagttggcaatagcatctttgtgcttatagtgctgtagctcgtgtaacagcatgtatcgcatgtccgattcgttataatctgagatgagatgaatcggcagataaatacaaggtttcaaaagccccacaataatcggagatttcaaaaatgcagtactgtaaacatggatatttctgttaattcccatttctttcatacatcgatgatatagttttcggacttccgggttctgaaggggaagtgcagattttttcaagttctgtaagcggatagaggatttgattatcaatataatcattgcaaggatgcctacaagccatattccaaatagtatgtatccgatgctagatggagtctcactatttaccgaaagggcaaagtcattcatccagtctgcatttccggctggattgatcccaacagcttctcctatggcggttctggtgccagaagtaggagaacttttcaggctactgagccacgagaggatttgcggaaacccaattaaacggaacggtataaaaggaactaccaacaatccaagtagcaggaaccacagattatactgcatccggctggataggttgcctttgaatatccgcttggctatcaaaagaattccgatgataccgctgataaatacattgcatattaaaaagcgtatcataaaatcagccatgttaattacctcctttttttgacctcttggaaagaagagagcggagagtgtctatttccgtttcggacagtctgtcattttctatatatgcagacagcatggcagtgatgtccccatcgtagtatcgttctagaaaagagttactttcctgaccgatgtattcactttctttcacaactggagtgtaaacaaacacccgactttgtttttcataagtcagaacgcccttgttcactagacgtttaattagagtttgtattgtttttggactccagctcgtagtctgtaataatttatcagttatttcattggtgctgatcggcgcatgtttccatacgattttcataacttcaaattcagcttcagaaatctgtggtaaatcgctcatttcaaatccctccttaaatcttacggctgtaataaaaatattatagatgttatttgtgtagttgtcaatttaagagaaaatagattgacttgaaatcttacttatgtaataattaaaatattacacaagtaagatataaacaaaacatgtacttaaattaagaaaaccaacagtgtcacatggattccattggttttcttaaagggttggcttgttgtgtgttcgcatcaaattgagtagatagcgaacggcaggaatcagttcttctgattcctgttcagtgcaatcatccagcagagcaaggagtctttcatgatttgggcgaggctcctttctgtcaggatagaaaattttattgtcagtcagattcaagtaccggataagggcacaaagattttcaaattttggattgccacgtccgttttcaatgttgagtatggtacggctgtcaaaagctaaaatttcagcgagttgttcctgcgatagtccgagtttagtgcgagcttctcgcactgcatcggcaagattttgttttatgtcctgcattgtaattcacctccagagtagtttacattacacattaggaagaatgaattactgtacaatacagttttaatatggagtaaaatacataatgagaaagaagaggaaaagatataggtacatattattaaatacaaaaatgaataaggaatactacacacataatggtgtattgcaatagaggaaaaatacctcgttgcaatacaccttttttgatgttgttttttacagagatgtttgattctgttccggcttgtattcagcggaatgtatcttctccagagtccggtcaagatactggtttatgttctccagttttctgctgagatttttaatttctttttcggcagatttgtaggtgttctgtaaagtttcctttttggaatacagagcattgtatttgctgcggagtttgtcaacatcaagggtttttaggttaattccaaagcgttttaacatattttccgcaccgtcatgaagcaggagttctgtttcgtgtctgtgtaaataggcgtccggatcttttgatttctgataacgaacgtgatagatgtgattgactttgtattgttccgcatatttcaaaatcagtcctaaatcttttagctgatgctccgtttctataaggttgcttcttgcagtttttgcaaggagtgacttggtagcaagctgtttttccagctcggtaatggagtctgcactactgtagcttgcggctgctatttttagattttgaatgtcagcccaatgctttaaaccgggactgtgttcaaattttccctcagaggtgtcaatgagccttttggaagaaaagtctctggcaataggttttgattttcgaggaaaaggaacacgcttttgtggctgcaccagactctttgattcgatacgttctttaatacgctctttggtgtattccacccccagagatttgatgctgccacggacaaaacgttctctgtcaagagggcggaaggcaatatattttaagtcagattcagcaaaggtttcgccttttatttcataaccttttgcccgaatgagttcaagaaaatcctcataagaatcggctgcccgtacagcttcatcaatgtctgttttgagcttggctttccatgaagaaccgttgttgtcagaaagccatttcctgtatttctttccacgttgctcagtgggagaaatgactgataactgatgctcgttacatagttcatcatttaacttccggatatggtaataactctttttacaatcgtgatatttttcatgattgatgttatctgcagcacagaaaatgaggtggttatggacgtgttctctgtcaatatgggtagccacaacataagagtattttccttccaaaagtttgtcagcaagctctatgccgatttgatgagcttctttataggatacctcgccgggcatgaaagattgtatcagatgaaaggctttgtttgaatcagcctgattggtttttgacagggaaaacttgaaatcataagctgccgtttcaggactgcatccaaaggaagaaatgaggatactttcatcggtttttgcagggttgcaaatgtaagctactgctttatggacggttgctttgatagcatggatttttgtgattgccatacctgtttcatcagctcctttacttctttgacatcggcttcatacacattcccggttgcgttcatccgcttggcaatctggtttaagttattgccgatacgggcgagaagtgtgttgtattcccgcaagtgttcatagtttacgtcatagacatatccgtacagaatcatgtgccggataaaggcagatttgcttttcatgccggagattttaaatttctgttcgagtatgtactgctcgtcatcgctcagatagattttcagttcgttttgtcgttctctttgtgccattgcttcatcctttccatatttaagatagaagattttgtaatatgccgtttccggcggtgagtatttttgtgtactaaaatcagaaattccggtttggcaattactgattttggaagcatcagggggtcagggggatatgcccattgcaagccaattttttcaagtttctgaatggcaggaacttgtggaaatggtgcctgtgagggaacacaggcagtgcttgctatctttggcaaactgtccgtaggaagtttgcgtgttgtacgagcttaggcgagtgttcaacaacacataaggacattattgtccatttttggactgcttttatgcggtccggctttgtagagctattggcataagcaataaaaaactgctatggcttattgcaggcaagagatgcccgtgaagctccatagcagtttgagtgtttttataaatttatgattttatccataaaagattttagcaacagaaaatagcaaagtcaataagagaaagcggagaagataggaacttttggatatgtaaaaggaagccctgattgtatcgaaagcgattaggagaaaaagcttatctgaatatgaaaggttttttccggttcattttttacaatgagataggagaatttacagaaaggaggtaaagcatgaatacagcaggtcgcagagctgaaataattagtattctaatggttagacgtcgcatcacggcgaaagaattggcagaagaatttaatgttaccgttcgcacgatacaaaatgatattcaggctttatctcttggttttccaatctatacaagacagggaggagatggtgggatttttgttggggataattacaaaccatatatgaatacattaacaccacttgaattgaaagttttgcatgaaatgtatgggctggcagatggaatacataaaaaagttttatttcagcttatccgcaagtatgggccggataaactggaactctaaacttgtcattcttgtaaagcacataatttttacaacaccgttcatagcagacggaagtggtttatgtgctttttggactgataagtccggagttgattttatccaaaatgcaggcggaagcctgtaagtgtaccttgacaattttatagacaaatgcgtgcaggacgtgtggaatatgtggagccactatgcggatacgccaagagctgtctgctttcctatacaaataaggaaggttcttatatgaagaaatgctgaaatagggtattgaagtaaagacaaggagcgataaatgtctggcaaaaagtgaagcagttgcacagggcgatgatacatatttttaataatgatacttccggagatttccggtcaacaaggattgacggtgcgataccgatgtgggcggtgtaatgagctgccacctgtactgtatttttaaaaagatttgtctgctgatgagagttgggaaaagttttcgtggttgtcatgggcagataaagtcatgcagagaattagtgaaatggaggtgttggcgataaatacaaatataacagcaggcaaaatgtctgtgccgatatgggaaaagtatatgctgactgtagatgaagcagtacagtattttgggattggagaaaagaagataagatcattgattgcagagaatatggatacggaatattgttttacggttcaggtggggaataaatcattgataaatagacaaaaatttgaaacttttcttaatcagattacatccctttgattgaaaaaacaaagataatttaatactttaaagtggaaaaagaaagcctggtatgatataattgtcctatcgtgctagggtttcttcgtggaaaggagcgaaggcgtttgaacgaaagaaaacgtgaccagaaaagacgagataaaaagggtcgtattttgcgtaacggagaaagccaaagagcagacggaagatatgcgtttgtatatacagattgttatggaaagcagaaattcttgtatagctggaaactggagccgacagattccttgccagtcggacgtagaccttgtcagtcacttcgagaaaaagaaaaaattgtcctaagagaaatagaggatggcattactccttatgggggcaatttgacagtccttgaactggtaaaaaagtacattagacaaaagacaggggttcgccataatacacaagctaattacaattttgtaatcaatattattgcgaaagaggattttgggcagaagcgtattgataccattaaattgtctgatgcgaaagaatggttgattaagttacaggcagatggcagaggatacagttctattcacagcatacggggagttgtcagaccagcttttcaaatggcagtagatgatgaacttttacgcaagaatccgtttgaatttcaactatcaacagttgttgttaatgacagtgttaccagagaagcaataaccagaaaacaggagagagctttacttgagtttgtcaagaatgataaacatttcagcagatattatgagggcatttatattcttttcaaaactggactgcgtatttcagaatttgttggtctgcaaaagtcagatattgattttgaaagtggtacaataagggtggatcatcagttacagagaaaaagagatatggagtacattattgaagacaccaaaactccagatggcgtaagatttctgccaatgacaaaggaagtaagagagtgcttcgaatgtattattgccaagaaaaaaagaccaaagatagagcctacggtcagggataagaacggaaagctgtatcatggattcctttatctggataaaaatgatatgccaatggtagctctgcattgggaaaaatattttgaacatattataactaaatacaacagcatttataaagaggaattgcccaaagtaacacctcatgtatgtaggcatacttactgcagcaatatggttaagtctggaatgaaccctaagacacttcaatacctgatgggacatgcagatataggcgtaacattgaatacatacactcatgtaggtcttgatgatgtaaaaaacgaaattgaccgagttactgcattatcgtgtgtggaagcataggaaatgtgtacaattaagcaaaatcctaagtggaaaagtctttagtaaaatgagaaaatcgagatgttttactaagatttttactaaatttggatgagaaaatataccaatttatgccactatatgcgaagaaaaagcggaatacgttctgccggagaatatcatagaagtggcgtaaatacagcgttttaaggagttttagagcattgattagagtattatttatctgccacggcaatatatgtcgttcaactttatcagagagtgtatttacttataaagtaaaagaattaggtttgtccgacagatttgtcatagacagtgctgcgacaagcacagaggagattggaaatcctcctcacagaggcacagtaaacaaattaagagaaacaggaattccattagtgcctcatagagcaaagcagatttcgttgtcagattatgataagtttgactatatcatcggaatggatactgcaaatatacgaaatttgaaccggatattaaagggagacccagagggaaaagtgtacaagtttctttcttttgcaggttcgggaagagatatagcagatccatggtatacaggtgattttgatacaacgtacaatgatgtaattgagggatgtgaaggatttttagaatatctgaaacaagaaaataaaatctgatttaaccgaatcaagtaagttttctgttttaattgtaaaaagtaataagtagagatagaaatttgctggtatcaggttgactgaaaaacggggaaagtaagagtggtttttgctacttactttccctgtttgattatttcaataattcttctaagtcagcttttggaacaacgccaatggattttttgtaaacttctccatttttgaaaacaacgatagctggaattcctgcaattctatagcgtgatgcgagttccggtgcttcatctacgttaacttttccgactttgtaagcaccgtttgcttcatttgccagttcttcgacaatcggagcaagcattttgcaaggcatgcaccatacagcccaaaaatcaactaaaacaggaacatcagagtttaaaacttcttcttcaaaattttcattggttaatgtaatctccataatttacgtctcctttataaagttagtaagaataaaaaaagttacttggtatttttaataaattttactgcctttgtaccagcctgtgcgccttcgtacacggctttcgcaatttgcatcatacctccggtgcaatctccggcggcaaaaaagccaggaagcattgtggaagtatctgtctcaatcataatatgattgtcttttaaaatcaatcctaattttttggcaatgtcggtacttccggcacttccaagagcaacaaataatccatcaatgttaagttttgagccgtcttcaaaagtaatccattctaaggaattttctcctccaacggaaagcagtttcttatgattgacctgaatgtttccaagtacagaggaatcaaaagtttcagtcagtccgttggtaaagatagtcacggcttttgcaagaggttcaagaacttttgcttcgtgaagcgcatagtctccgtttccaagaattccgacatttttatttcggaagaagaaaccgtcacataccgcacaataactgatgccatttccttcgtattttttggcttcttttaaagtaatcggatttcgttttgcaccggtagcaaggatgattgcctggctttcataggaatgaaaagaagtctgcacttgataaacaccgttatcataagcaatcgaaagaagttcttcttctgcaacaggaatattaagtgctttaagttgagaaagaccggtttcgtataatttttcaccggaaatgggagtgggaagtccgtaataattttcaattatggaagccttttttaaagcaccaattccgttatgaatgaccagtggtgttacgccaagacgaatggcataaagggctgctgaaactccggcaggacctgcaccaacaatgataagctgtttcattttttcatcacatccttttttatagaattaatgtgttttgctcatctctaataatcgtagtatcaaataaagagagattgtttctattttaccacaaattccaataaaaaacacgcaatatcagaaaaaaacgaaagagaaaaaagaaaaattatatgtaagattacacaaaaaataagcctttttttgtgtaagggggcattttttggaaattggtaaaaccaaaaaataagcgaaaatactaaaaataatattaaaatagcaaaaaaaacgtacaaaatacaggagataatccggctgtatactgataggtacacaaaaagcaacgaaaatcactagccaaaatggaagagaaacaaaaaaaattaccgaaaaacagacgaaaattggggaaaacagagaagttgtcaaaagattgacaaaaccattttttgggagtaaatttagacacgaattagagtatgaagaaaggagttttagacaacaaaattttagagaaagggaggatgtcctacggatatagcggaaatgattacggaggagcttaactgcgaaaccgtttttaccattccagtttttggtggtataccagtaggagagtctactgttgtcacctggattattatggcggcacttaccattatctctattctattagtcaggaacctgaaagtggaaaatccaggaaaaaaacagctggcattggaagctggaatcggtttcttacaagatttcttcacagatatcttaggagagagaggcaagcgatatgtaccgtatttgattacggtggccatctatataggcgtggcaaacttaattgggcttcttggatttaaaccgccaacaaaagacttaaatgtaacagcaggtctggcaattatgagtatttgcctgatagaatattccggatttcgtcaaaaaggactaaaaggttttgtgcatagttttgcggaaccgatggcaattgttactccgattaatattatggaaattgcaattcgtcccgtatccctttgtatgcgactttttggtaacgttatcggtgcttttgtcgtaatggaattaattaaaatgattattccggttgcaataccggtgccgctcagtctctattttgatattttcgatgggctgattcaggcatatgtatttgtatttttaacatcgctctttattaaagagcaaattgaagagtagttaatgaagaattaatgaagagtaatcaaaaaaaataagaagcgaaaaggagaaatgaaatatgttaacagcaattggtgcgggtatcgcagttttaacaggtttaggagcaggtgttggtattggtcttgcaacttctaaagcagtagaagctattgcacgtcagccggaagcagagtcaaaaatcagtaaagcattgttattaggttgtgcccttgcagaggcaactgctatttacggtttcgtaattggtttgttaatcttattcgtaaaataaggaaggcaggtgaagacaggtgctgaagttaggctgggaccttctctggaccattattaacctgattattctttatctcttaatgaaaaaattcctgattggacccatcacaggaattatggaaaaaagaaaaaatcttattgcacagcagtttaaagacgcagaaacagttcaaaatcaggcacaggaaatgaaaacacagtatgaaactgctttaagtggtgcaaaagaagaatctgttcagattattgccgatgcaagaagtgatgcgaaagcacttggcgaacgtactttaaaagaagcaaatgaaaaggcttcaagaattcttgaaaatgcaagaaatactgctgaacaggaaaaacaaaatgcaatgtcaggtgcaaaatgtgagattgcagatttggctttggaagctgcaaagaaactgcttagtcagggaagcagcaaagagggcaacagtatgttatatgaccagttcttagcagaaacaggtgatacagatgacagaaactaattatgcaaaagtgttatatgaattaaatatagcaccagaagtgacagcgtctgcaaacgcaatactgaaagcagcccctgaagtatcagaggtactttctagtcccgttgtttctttaaaagaaaaggaaaatgtgattgataagatttttccaaaagaaatatgtaatttcatgaaggtgttgtgccgttatcacaaggcatcccttgcacaggagatttttaaagaatatcaggagtattacaataaacgacataatatcttaaatgcagaactattttatgtggtagctccgaaaaaagagcagttagatggaatgaaaaacttcctatgtaagaagtaccacacgaaagatgtgcagataaaacaaatcgaagacaaatctttaattggaggattttgtattcgggtagaagatgaagaaattgattacagcttaaaaggcaaaatcaatgcattacaacaaaaattaacctggaggtgaacggtttgagttcaatcaattcagaagaaataatttccattctgaaagaagaaatagaaaatttcgacatggcaactggcgtccgtgaagtaggaaatgtaatctgggttggtgacggaattgcaactgtttacgggatagaccacgcaatgtatggtgaaatcgtgacttttgaaaatggcgtcaaaggtatggtgcaggatatcaaaagaaacgagatcggtgttattatctttggtaaagacacaggaatcaaagaaggcactaaagtagcacgtacaaagaaaagagcaggtattccggttggcgaaggctatatcggaagagtggtagatgctctgggtgctccaattgatggaaaaggtagtatcgaagcgaaagattaccgtccaattgaaaatgaagcaccaggtattattgaccgtaaatccgttaccgtaccgatggaaacaggaattcttgctattgactccatgctgccaatcggtcgtggacaaagagaattaattatcggtgacagacagaccggtaaaacgtctattgcaattgatactattttgaatcagaaaggcaaagatgttatttgtatttatgtagcaatcggtcagaaagcttctacgattgcaaaattaactggaacattggaaaaatatggtgcaatggattacacaactgtatttgcagcaacggccagtgactgtgctccgctgcagtatattgttccttattccggaactgctttggcagaatattttatgtatcagggaaaagatgtattaatcgtatatgatgatttatccaaacatgcggttgcatatcgtgcactttctctgttgctggaacgttcccctggacgagaagcttatcctggtgacgtattctacttacactcaagacttttggaacgttcaagtcgtttaagtccggaagcaggtggaggttccattactgcacttccaattattgagactcaggcaggagatgtttctgcatatattccaacaaatgttatttccattacagatggacagattttcctggaaagtgatttgttctttgcaggtaatcgtccggcagtaaatgttggtgtttccgtatcacgagttggtggtgctgcgcagacaaaagccatgaaaaaagcaagcggaagccttcgtattgatctggctcagtatcgtgagatggaagtctttacccagtttgcgtcagaccttgatgatgcgacaaaagaacagttagcttatggaaaatgtctgatggaattattaaaacagccactttgcagaccgctttccaaccatgaacaggtcattaccttgtgggtggcaacacataaagtcatgctggatgtggaattaaagaaagtaaaagaattccagatggatatgctggcatattttgataagaactatccggaaatcggaaagcagattgaagagaaaaaagttcttgatgaagaacttggaaacaagattcttgaagtagcagaggaatttaaaaacaagagcaggtgatagaatggcaagtgcaaaagagattcaaagccgaataaaaagtattcaggatacgatgaaaattaccaatgccatgtatatgatttcctcttctaaattaaaaagagcaaaacaggtattatcagatacagagccgtatttctatggaattcagtcggcaatcggacgtgtgctgcgtcacatgccggaaatggaacataaatattttgacgagcgttctgacattccaaaagaagatagaaaaacaggatatattgtagtctccgcagataaaggtcttgcgggagcatacaatcataatgtgtttaaaatcgctgaggaatgcatggaaaaggaagcccatccacagttgtttgtacttggagaggtggggcgtcagtattttgccaagaaaaaaatggatgtggatatgaatttccgctttacagtccagaaaccgacgatgcatagagcgagagtgatttccgaggaaatgattgagcgttatttaaagggagaattggatgaagtgtatattatttatacacgaatggtaaatgcagtcagcatggaagcagaaatgagccagcttcttcctttgaaaaaagcagatttccatacaccggctcaggtaatggtagacatccatcaggaggaaattgaaatggttccttctgcagaagaaattttaaatagcatggtgccgaactatctgcatggttttacttatggatgcttagttgagtcttatgccagtgagcataattcccgaatgatggcaatggatgcggcaaccagcagtgcaaaggacatgctcaaagatttatcaattcaatacaaccgtgtgcgtcaggctgcaattactcaggaaattactgaggtaatcggcggtgcaaaagcacagaaaaataaacattaaaaatacagaaaggaggattcctcgtggaaaaaggaaaaattgtacaaatcatgggaccagtcgtcgatgtggaatttccacagaacgcacttcctgcgattaaagatgcccttactgttgagaataacggaaaaaaactggttatggaagtagcacagcatatcggtaataatactgtacgttgtattatgttggcttccagtgacggtctttataaagatatggaagtaacagcaacaggtgctggtatttctgtccctgtaggaaaagaaacattaggtcgtctttttaacgttttgggagaaaccattgataatggagaacaattagataatgcagaacattgggttattcacagagacccgccaagttttgaagaacaaagtccagtcgtggaaatccttgaaacaggtattaaagtaattgacttattagcaccttatgcaaaaggtggtaaaattggtcttttcggtggtgccggtgttggtaaaaccgtattaattcaggagttaatcagtaatattgcaaccgaacatggtggatattctatctttaccggtgttggagaacgttcccgagaaggaaatgacctttggagtgaaatgaaagaatcaggagttcttgaaaaaactgcgctggtgtttggacagatgaatgagccgcctggctctcgtatgcgtgtggcagaaaccggactgactatggcggaatatttccgtgaccaggaacatcagaacgtattgttatttattgataatattttccgtttcacacaggctggttctgaagtttccgctctgcttggacgtatgccgtccgcagtaggttatcagccgactctggcaactgagatgggtgaattacaggagagaattgcatctacaaaaaatggttctgtaacaagtgtacaggcagtttatgtgccggccgatgacttaacagaccctgctcctgcaactactttcgcacatctggatgcgacaacggtattgtccagaaagattgtagaacagggtatttatcctgccgttgatccgttggagtcaaactcccgaattctggaagctgatgtcgttggcgaagaacattatgaagtggccagaaaagttcaggaatatctccagaaatataaagagctgcaggatatcattgcaattcttggtatggaagaactttccgatgaagataaaaaagttgtagcgcgtgcaagaaagattcagaagttcctgtcacagccattccatgtagcagaagtatttacaggtattccaggaaaatatgttccgttaaaagaaacaattcgtggatttaagatgattatcgacggtgaagtggatgattgtccggagagtgcattcttaaatgccggaacaattgatgatgtcttagaaagagcaaaagcagaacaataggggtgatgtatagatgaatacattcggattaagtattgtggccagcgataaagtgttctttcgaggcagagggattaatattgtaattcctgcacaggatggtcaggtttcgattctggctcaccatgcggatatgatgattacggttgttcctggagagatgcgtttccagacagaagatgaacaatggcatgaggcaattgtaggaaatggctttgcccagattatcaataaccgagtgtcgttgtttgcggacagtattgaaaaaccggaagatattgatgagaaacgtgcaaaagaagcattagagcgtgcagaagaacagcttcgccagaaacagagtatgcaggaatattatgtatcaaaagcatctcttgcaagggcaatggccagaatgaaagcaagtaagagacatgagtaaggaaagtgtggagagaaaaaggctttctctccacctttttttctacaataaaatataactttgagttatgatttgcatactaattagttataacgtggcaaatccattgacaaaaaaataaatagttgatagaattacaagaaagttaagcaatgattgcttgacaaatgaaatggggagaaggtgctgtatgaataaaagaattttatcaattctggtagaaaatacggctggtgtcttaagtcgggtttccggtttgttcagtcgaagaggatataacatcgacagcctttccgttggcattacaacagaccctaattactcacgtatgactgttgtgtgcagcggtgatgaactgattcttgaacagattaccaaacaggtggaaaagttagaagatgttctcacagtaaaagtgctgaaggacggtcagagcgttaaccgagaattgattcttgtgaaagttcgggtagaaccgaatcagagagcggatgtttcttcgattgtagatattttccgtgcaaatattattgatgtgggaaaagagtccatgattattgaactgacaggaacaaaatcaaagctggaagcatttattgatttgttagaaggttacgaaattttagaacttgccagaacaggtatcaccggtctttcaagaggggtagatgatgtattctatcttgaagaagacggggaagattattaattaagttagctagagaatgattttttattccctaagataaaaaaacacaaaatgctaggaggaaacaaaaatggcagtaaaaatttattatcaggaagattgtaatttatctttattagaaggaaaaaaagttgcaattatcggttatggtagccagggacatgcacatgcattaaacttaaaagaatctggtgtagatgtaatcgttggtttatatgaaggaagtaaatcttgggcaaaagcagaagctcagggattaaaagtttatacagcagcagaagcagcaaaacaggctgatgttatcatgattctgattaacgatgaaaaacaggctgcaatgtacaaaaaagacgttgaaccaaacctggaagaaggaaacatgttaatgtttgctcatggttttgcaattcactttggacagattaaaccacctgcaaatgttgatgttacaatgattgctccaaaaggtccaggtcatacagtaagaagtgaatatcaggctggtaaaggtgttccatgtctggtagctgttcagcaggattacacaggaaaagcattagacaaagcacttgcttatgcagctggtatcggtggagcaagagccggtgttctggaaactactttcaaagtagaaacagaaacagacttattcggtgagcaggcagttctttgtggtggtgttacagcattaatgaaagctggatttgaaactctggttgaagctggatatgctccggaaaatgcttactttgaatgtatccatgaaatgaagctgattgtagacttaatctacgaaagcggattccagggaatgcgttactctatctctaacacagcagaatatggtgattacatcacaggacctaagattgttacagatgaaacaaagaaagcaatgaagaaaatcctgtccgacattcaggacggtacatttgcaaaagattggatctcagaaaaccagacaggttgcatgcatttcggcgctatgagaagaagagaagcagagcatcagttagaagcagttggtgaagaacttcgtaaactgtacagctggaatggtacagacaaattgatcaataactaattttaatttgagtatcagataaaaaaagaaaaggcgacggacaaatgttccgtcgctttttagattttaagaatgtacagggagtttatttaaggcaagcccctgtttagtattgtaaaattcaataaattcccgaacagccgtggtttgctgtaaattatccagataagcaaaaccaatatttctgcggtgaattggaaaaggaaggggaatttctacaagctctccttctgcgagttctttttcaacaaattggcgaatgacgcaggcaacccctaaactgatttttgaaaattcgattaataaatccatagtagaaacttcaagaaggttattggtttcaatacgatgagcagcaagataatcatcgatatactggcgggtcatgttttctttatcaagcagcattaaagtggcattgcggaaaatgtcgtctctatgattggtgcgaagagaaagattgtttaaataagttttggtgcttacaaaaatatcttcgatttcaccaagactgtcaaaatgtacatgatgaggacgttccggttctccaattaaaccaacatcaattttattttcttttaagagttgcagagtatgattggttgattgacattcaatggtaatctttatatgtggatgtgttttaataaattcctgaagataaggcagaagcataaatttacataaagttgtactgactccaatatgtaaatgaccaatgcccagttcgttgatttttttaatacgggattcccctgtctggagcgaaaaaaacgctttttgaacgtaggtgtaaagaatttccccttcttccgtgagttgaacccctcgggaatttctggaaaataatgtaacgtctaaactctgttctaatttacggattgatttactgattgcaggctggctgataaaaagttgttctgcagcttttgaaatatttccggtattggctacggtgtagaaaacacggtataaggataagttttgttccatcttagaatctccatttttctttatgaatataagttatatctgatatgttttatatgtatttctattatatcaaaatttgtgctagaatatcaatagataaaagcagacaaaggtctgctaccataaaataaatttttagtgtatttttagggaggaatatccatgggaatgacaatgacacaaaagattcttgcagcagcagcagggcttgaaaaagtagaagcaggtcagctgattgaagcaaatcttgatttagtactgggtaatgatattacatctcctgttgcaattcatgagatggataaaatgacaaagaaaaatgtatttgataaagataaaatcgctctggttatggaccattttatcccaaataaagacatcaaatccgcagaacactgtaaatgtgtacgtgaatttgcctgtaagcatgatatcacaaattattttgatgttggagaaatgggaattgaacacgctctgcttccggaaaaaggattaacagttgcaggtgatgttatcatcggtgcagactctcatacttgtacttatggtgcacttggtgcattttctacaggtgtaggaagtacagatatggctgccggaatggcaaccggtaaggcttggtttaaagttccatctgcaattaaattcaatattgttggaaaaccggcaaaatgggtgagtggaaaagatgttatcttacacatcattggaatgattggtgtggatggcgcactttataaatctatggaatttgttggagaaggaatcaaaaacttaagtatggatgaccgtttcacaattgcaaatatggcaattgaagcaggtggaaagaacggaattttccctgtagatgaactgacagaacaatatatgaaagaacattccaaacgtccatataaggtatatgaagcagatgaagatgctgtttatgatgaagaatatacaattgatttgagtgaattaaaaccgaccatttctttcccgcatcttccggaaaatacaagaacaattgatgaaattacagaagatgtagtaatcgaccagtctgtaattggttcttgcacaaacggaagaattgatgacttacgttgtgcagcagaaatcttaaaaggacgtaaagtgaaaaagggagtccgttgtattgtaattccggcaacacagagtatttatcttcaggcaatggaagaaggattattaaagatctttattgaagcaggtgcagttgtaagtacaccgacctgtggtccatgtctgggtggatatatgggaattttagcagctggagaacgttgtatttctactaccaaccgtaactttgtaggtcgtatgggacatgtagattcagaagtttatctggcaagtccggcagtcgctgctgcaagtgctgtaactggtaaaatttctgtaccggaagaattaggtttatagtaggaggaaaagacgatgaaagcaaacggaacagtatttaaatatggagacaatgtggataccgatgttatcattccggcaagatacttaaactcttctgaccctgcagaacttgcacagcattgcatggaagatattgataaagactttgtaaacaatgtgcataaaggagatatcattgtagcagataaaaattttggatgtggctcttcaagagaacatgcaccaattgcaattaaagcggccggtgtcagctgtgtaattgcagaaacttttgcacgtattttctaccgtaatgcaattaatattggattaccaatcattgagtgtccggaagcagcgaaaaatattgaagcaggcgatgaagtagaagtggattttgacagcggtattattacaaataaaacaaaaggacaggcttttaagggacaggcttttccagagtttatgcagaagattatcaaagcagaaggtttaattaattatattaatgcaaataattaatatcaacgaaaataattaataaaatgaaatgcaagtggaattgaaatgttctgcttgcatttttttgtgacacataatccggagcttgcaaaacaaatttgtacgaggaccattaatcttgcagagattaataaaagataagaaaaatatataatataataggtagaaagaagtacaaaaaacttgaaaaatcgggtagagtgttcctgcccgattatcaaaaaaaggaagtttcttccttaaaattacttgacattttgatttggtaatgctattttaattatattaagcacagagtaatctgtaaacagcaaaatgcagagataaggattagtagaaatttttacggatttcagagagctgttggttggtgaaaaacagtagatgtaatattttgaactgcccttggagcagctgcccgaacttttactaataaagcaaggcgaggtaagatagtaggcgtagacggaatccctaccgttatcagcagggaaagatataagatggtttcatcagtatcttttgagagtatgaatttgattcatgaagtagagtggtaccgcgcaggacgttagtctttcgtctctattacaagtatattgtaagagatgagagactttttttgtttcagaaaaaagtggtaagttctaggaaaagaattatcaaaaagaagctctaaagtgatgtgccaaaatgattaggaggatttaagttatgaaaaacagcagtaagtacaaaagacagtattttttaccaccagtgaaatgtatggactggaccgaaaaagatcatgtagaaaaagcaccaatttggtgtagtgtagatttacgagatggaaatcaggcacttgtaattcctatgaatctggaacagaaagtagagttttttaaactgttagttgaaattggatttaaagaaattgaagttggttttccggctgcgtctgaaacagagtacacatttttaagaaaattgattgaagaagatttgattccggatgatgttacgattcaggttctgactcaggcaagagaacatattatcaagaaaacatttgaagcggtaaaaggtgcaaaaaatgtaattgtacatgtatataattctacttctttgtctcagagagaacaggttttccataaatccaaagaagaaattttaaagattgcagtagaaggtgcaaaattattaaaacagttgacagaagaagctggagcagattatcgttttgaatacagcccagaaagctttactggaacagaaccagaatatgcattggaagtctgcaatgcagtactggatatctggcagccaactgcagatagaaaagcaattatcaatctgccggttacagtagaacattctatgccgcatgtgtatgcaagtcaggtagaatatatgtgcaagaacttaaaatacagagaaaatgtagtcgtttctctccatccacacaatgatcgtggttgtggtgtagcagatgctgaaatgggtattttagctggagcagaccgtgtggaaggaaccttatttggaaatggagaaagaacaggtaatgttgatatcgtaacacttgctttaaatatgtatgcgcagggcgtagagccggagcttgattttacagatatctcttctatttgtaaaaaatatgaatcctttacgggaatgacaattaacgagagaagtccatatagcggtgcattagtatttgctgcattttccggttctcatcaagatgcaattgcaaaaggtatgcattggttggatgaaaagaaaccggaacactggacggtaccatatcttccaattgacccgaaagatgttgggcgtaattacgatgcagatgttatccgtattaacagtcagtctggtaaaggtggtgtcggatatattctggaaactaaatttggactgaatctgccacctaagatgcgtgaagcaatggggtatacagcaaaagcagtatcggatcatacacataaagagctgatgccagaagagatttttgaattatttaaacggacctttgaaaatgtagtaagcccgctgtccttaaatggagtacatttccagcaggtaaatggaggaattacaacacaggtaacttctatttttaatggaaaagagattacaacagaggcagaaggaaacggacgtttaaatgcggtaagtaatgcgttgaagaaagcatataattttgagtatgatttagtaacttatcaggagcatgcattagagcagagttccagttcaaaagcgattgcttatgtaggaattcgtaagccagatggtacactttcctggggcgcaggggtggatgtagacatcataagggcctctatagacgcattggtaactgcaatcaataatcgataaaagcttaaatttttatatcaaaatgttctcgagcaaacataatacctaaagacttggtaatgttaaattaagaaaatctcaatagcaaagcaggtatataagaaaaaatcattcttttgtacctgctttttttatgaaaaaccacgaaaaatcagagtaaatttggatgaaaaattgtccgagttttcaaataaatttatgtaatatagacaaaagacttttgaacttattgacttctatcctttaactatcatataattcaaaataactgattaggtgaaagtatagagatagagaaaatagtttaagagaacaaagggaaaaggtatgaacaagattcaaaaaattgaatcgaggcttcttagagtaataaaaagatgcttgagaaactggaaaagaaagcaaaagaaaaaacaggttcgaaaaagcagaaaaagggttagaactagaagagagattcaaacgagaaagacgtcaggaaaggcagcacagagaaaaacggggaaaacaggtagtcagcacagacagtcacaggcaagacgaaaaaatgaaagaaaaattcaggaaaaaagacgacagtttattttgaaaactgctgcgtttgcggcggtgggagtattatctgcggcaggagtatttctggttaaaaaacttactatacaggctgaggcttcttcagcaaaatcggtagagactgtagtagaaaaagcacaggaagaaaataccagacaatacatgtatgggattgaatccattatttccggtgtctgtatcagtcaggacacggatagtgaggtaaataaattaggaacgtcttgtgaagcagttttagttggtcagcgtgttgggaaaaatcagcaggaatcgaatcttgattttagtaaagcggcagctgataccgtagaaaaactggagaatcattcgttagatgtggaacagtatttaaaagtgacagacagagattatgaaactttgttaaagattgtagaagcagaagcaggtggagaagatacagaaggaaaaatcatggtggcgaatgttattttcaatcgtttgcagagtccgatttttccagatagcatttatgatattgtgtggcagaataccgacggaactgctcagttttcaccgacagcagatggaagaattaataccgttactgtttcagaagataccagagaagcagtcaatcgtgcaattgatggagaagattattcacagggagcattgttttttatgcaggaagaatattcggattcagacaatgtaagttggtttaaaagggatttggaatttttatttaaacatggtgttcatgccttttatacatatccggaaaagacattgaaagaattagaagcgaatgcttcttcaaaaaagacagaagaagaaaaagaagaaccagatgattcttcaacgaagacagaaacttcaacggaaacaaaaatttcgcctagaaagaaagagaaatcttccaaaaaaggaaagacatctacagatgagacatcgaaaaagacaagcaaatccgatgcaatttaaatgtaagtaagctacaagatataccaattgaaaaaatagaagtgtatcttgacttaataaataaggaaaggacaaaaagacaatggaaattttgtacaaaagcacaaggggaacaggagaatgtgtaacagcttctcaggcaattttaaaaggattatcagatgatggtggattatttgttcctacacagattccggttttggatattcctgtagagaaacttgcatccatgacttatcaggaaatcgcttatgaggttatgagtcgtttccttacagattttacagaagacgaattaaaagcatgtattgaaagagcttatgattctaaatttgatacaaaggaaattgcaccggtgaaaaaggcagatggtgcttattatctggaacttttccatggggcaacgattgcatttaaagacatggcactttctattctgccacatcttcttactacttctgcaaagaaaaataatgtaaaaaatgaaattgtaattctgaccgcaacttctggagataccggaaaagctgctatggctggctttgctgatgttccgggaacgaaaatcattgtattttatccgaaaaatggtgtcagcccggttcaggaaaaacagatggtaacacaaaaaggaaataatacttacgttgttggaatcacaggaaactttgacgatgctcagacaggcgttaagaaaatgtttaatgataagaatatggcagaagagctttcaaatgcaggatatcagttctcatcagcgaactctattaatattggacgtcttgttccacagattgtgtattacgtatatgcttatgcaaccttatataaaaatggagaaataaaagcaggtgaaaagattaatgtcactgttccaactggaaactttggaaatattcttgctgcattctatgcaaagaatatgggacttccgattgaaaaattaatctgtgcatccaatgaaaacaaagtattatatgatttcttcagcacaggaagttacgacagaaacagagacttcatcttaacaacttctccatctatggatattttaatttccagtaacttagaacgtctgatttatcgtattgctggtgaagatgcagataaaacaagagaaatgatgaatgagttatccaaagatggaaaatatgaaatcactgccgagatgcgtgcgcagttaaaagatttctatggaaattatgcaacagaagaagaaactgccaaaattattaaaaaactgtatgaagatacgggatatgtcattgatacgcatacagcagttgcagcctgcgtttatgaaaaatataaaacagctacaaaagatgatacaaagacagtcattgcttctactgcaagtccatttaaatttacacgtagtgtaatggatgcaattgatcataaatatgatgcaatggaggattttgaactgattgataagttatctgaaattgcaaatgtgaaagttccaaatgcaattgaagaaatccgtactgctccggtactgcatgatacagtggtagaggtagcagagatgccggcaattgtaaaaaaattgttgaacgcttaaggtttaatgagagaaaatgttgactttttagttattacatgagataatacttgagaatttagaaaaactttcataaaaaaccaatttttattcagtaatttttgttgaaaaacttcatatactagagtataatgaaatcacgaagtaatcctgggttgtgcgatgctcctattatttttgaacctacatttactttaaacgggattcctatattgccagttggatgtcaggccgtcattgcgcagcggaaggcagaagaatggttgcggtcacccacctagcaacagctaggagtcagaagataggaaacggcatctcgggattacttaattttatgtttgaaattagggagaaaacagatggcaatcacaaaacagagtttcggaaagagtacggatggaacagaagtttttctttatgagattacaaatacatccggagcaacgatgaaggtaacagattttggagcaattttggtaagtcttatggtaccggatgaaaatcataaattaagagatgttgttttaggctatgatactgtagaaggatattatgaaaatccgcctcattttggttctccaatcggaagaaatggtaaccgtattggaaatgcttcttttacaattgatggtgtgacttatcagttggaaaaaaatgataatggaaaaaataatttacatagtggcccgaatttctatcgtaccagagtgtgggatgttgcagaaatagatgcagagaaaaacagtattacattttctattaagagcccacatttagaccagggatttccgggaaactttactgcctttgtttcttatactttgacggaaaagaacgaattggtattggattataaaggaattgcagataaagatacgattgtaaatatgaccaatcattcttattttaacctggcaggacatgatgcaggtgcagaaagtgtaatgaatcatcttgttcagattcatgcagaagaatacacaccaaccgataaactgttaattccgacaggtgaaattgcgccggtagcaggaacaccaatggattttacaacaccgaagaagattggacaggatgtagatgcagattttgaacagcttattatggcaggtggatatgaccataattatgctttaacccgtaaaaaaggtgaaatgagagaagccgctgtagtttggtgtgaggaatctggtattcagatgaaagtttatacagaccttccgggaatgcagttttatatcggtaattttattgaacaggaaaatgggaaagctggatgcgtttatggaaagagaagtggtttctgtatggaaacgcagtattatccaaatgcatgtaatgaagaaaaatttgaaagctctttattaaaagccggagaagaatatcatactactacagtttacgcattttctacgaaataaaaaataaaaagtttgtatgcccgtcaaattgtattttatcttaaaatggaatactgtttggcgggcttttgtaccaaaatgcagatatttgaaaaagaatatctgcattttttttctcatatacttaagctgaaattttatttgaccggagcttagggatgaaccgaaactatctgattatctgcttatgctgtgttcttgctctgaatggattaggaatacaagaactgaaaaaacaaagaatagagttaaaaccagaaacagaagaactgataaaaagggaaaatgaaaaaaaagtgatacaaagaaactctaaagaaaaaatggaagaaacgtcggaaagcaaatcaaaatccgaagaaaaaagaacaaatgcagaaaaatcagaaacaaaagaagcaaatcaggagttagaaatttcggttgcaattatgacaggacagtatacatcttattttcatgaacggatagagttagagtttgaatcagattatcaggaagaaaacagtggaaaactttatttagcaaacgaaaaactggttttagaaaaagaagaggaattgtcagaagcgggaaggctggtgttatcgcctgttgatcggactaaagaaaatagaatcagagtattgtcggtagaacgaggacaaggaacaccgtcttatgggggaacgcttatcattggaaaagaaaaagatggctggtatgtggtaaacaggctaccgttagaagaatacctttatggtgtagtaccaagcgaaatgccttctgattatgaaaaagaagctctaaaagcgcaggcagtctgtgcaaggacttatgcctggatgcagatgcagaaaaatcaggatccggttgggattggtatcgctcaggtagatgacagtgtttcttatcaggtttatcaaaattcaggagagtctgagacagcaaaagaagcagtagatgagacaaagggagaaattttaataaaagacggacagccgattactgcttactatttttctacttctcatggaaagacgagtacaaacgaagtttgggaagcatctgctccggccagttatttaaaaagtgtagaatgtaaattcgatgcggatgtgccgtggtatcagtggaaagtatacttttcaagtgaaagactgcttgaacaggcaaaaaacaaactttcagacgcatcagtgcttgaaaaaatggaaattgagaaaacaggagaagcagatgctgttttaaaattaaaaatagagacggatataggtgtcattcaacttgaaaatgaatatgagatacgtgaatttttaagtccacagaatcttgaaatcgtacgccaagatgaatcaacagtaaaaggtggcaaattgcttccaagtgcctattttaccttggaagcacagatagatgaaaatggaaaaccgcaaggttatatgattcatggaggaggatatgggcacggagtgggaatgagtcagaatggggcaaatcaaatggcaaagcttggaaataattatcaagagattttgaattatttttatcaagaggtagagattgccccaattagtggggtgtgatataatgagcgttagccggctaaagcaggtaaagagaaaaatatagtttaaaccgagtcaagcggcaaaattgattgcgagtatctgcttgcgaatagttgcttaatagtaatagataataaaggaaaacaggaaaaaacattgagacaaggattttaaataaatgagaataatcaaaaaaataattcgtgatatctgggggttttcaagaagtatcagtgaaaagcatgtaccggcttatgctgcgcaggcagcttattttattattttatcatttattccgtttatattgcttttaatgacttccataagatatactcagttgaatcgcgaagaagtggttggagcaattatgcaggtgattccggataacctgcatgagtttatacagggaattgtagatgaagtatataataaatcggtcagcattgtgccggtgtcagcagtgatggcgatctggtcatctggaaaaggtgtgcaggccttaacaaatgggtttaattgtatttattctgtctatgagacacgaaattatattttaaccagaattcgttctgctgcctatacgttattgtttgtgattggaattattctgacccttactttacaggtgtttggaaatacactgcaaagagaattaagacgacattttccgtttttaaataaattggtttcgatgattatcagcatgagattagtgattacacttgcaactttgtgcggagtgtttttgatcctatataaatttgttccaaatagaaaggcaacatttcgtagtcagtttccgggtgctgtattttcatccgtgtgctgggttgcattttcgatgggattttctttgtattttgaattttttaataaaacatcgaatatgtatggaagcatgacaaccattattctgattcttttgtggatgtatatctgtatgaatattgtaatgataggtgcttcaattaatcattattttgaggaacgttttcgttggatgcatcaggttgcaacagatacaatcaaacgagagtatcagcagtttgtacagcatgcagaggaatttgcgggagaaaagcgccaggaatggacaggagacgaaaaaaagagtaaaaaagaaaagaaatagcagagagtatttcttgacagaaaacagggaaatgactatcattataagttggtgtgtagcagatgatattaggtggggaaaataattaggatacttaattaggttatctggcgagttagagaaaggttttagataaattatgaaactttatgtaatacgtcatggagaaacaacatggaatgtagaaagaaaacttcagggagcatcggatacagagttaaataaaaatggaattgcgcttgctataaaaacaggaaaagcgatgaaagagattccgtttgatttatgttttacaagtccgttaaaaagagcgagacatacagcacagctggtactgggagatagaaaagacgtgccggtgattgaggatgtacgtcttcgtgagatttcatttggggagtgggagggaaaagactccagattattgccggcagaaatgctcgataatttttttcatcataccgaagcatatcagcctcccaaaaatgcggaatcattagaatccatttgtaaaagaacacaggaattttatgaagaattgattcaaaaagaggaacttcaggataaaacaattttaattgcatcccatggatgtgcagtaagagctctgcttcaaaatgtatatgaaaatccatctattgaaaatttctggagaggttgtgtacctccaaattgtagtgttaatatcatagaagtgaaaaataagatttcaaaattaatagaagaagataaaatattttgatcgaatcaagtagcaaagaggattgtaaatatccgcttgaattacaagaaagaaaaggagaaaccaatgaaaacatcagatttttattatgatttaccggaagaattaattgcgcaggacccgcttgaagatcgttcttcttccagattaatgtgtttggataaaaaaagtggtgagttgaagcatacaaattttaaacatattattgattatttaaataagggagactgtctggttatcaatgataccaaagttattccggcaagactttatggaagcaagattggaacaaatgccggaattgaaatcctgcttttaaaaagaaaagatggaaatgtatgggaaacattggtaaaaccaggaaagaaagcaaaaccaggaacaaaaatcagttttggagacggtttattaattggagaagttattgatattgtagaagagggaaaccgcctgattcgttttagttatgaggggatctttgaagaaattcttgacaaacttggagaaatgccgcttcctccatatattactcataggcttcaggataagggacgttatcagactgtctatgcaaaacatgagggaagtgcagcagcaccaacagcagggcttcattttacaaaggaattattagagcagattaaagaaaaaggggtaaatattgcacatgttacccttcatgtcggacttggaacatttcgtccggtaaaagtagatgatgtagaaaaacatcacatgcattctgaattttatgtagtagaagaagaccaggcaaaattaattaatgatacaaaaaaagctggtaaaaaagtaattgcggttggaacaacaagttgtcgtacattggagtctgcaacagatgaaaatggaatccttcaggcaaaaagcggatggacagagatttttatttatccgggatatcaatttaaaatgattgatgaactgattacaaatttccatcttccggaatctaccttactgatgctggtttctgcactggcagggaaagaaaatattatgcatgcttatgaagaagcggtaaaggaaaaatatcgtttcttttcctttggagatgccatgtatattcatgattaaattaagatttgatagaaaaagagatttataaaaaagatgttctgttcactaagaaacgtggcagaacatctttttatttttgacttgattaaaacaaaaaagaaatcgtttatttagcggagcaaatcacgatagaatcccggataagagatattaacacaatctgcattggtaatttctgtttcaccgtctgcaaccagtccggcaactgcaaaggacatggcaatacggtggtcgagatgactgtctaaaacagcaccatgaagtgattttcctccacggataatcattccatcctctgtgccggtaatatcacatcccatttcgcttaaatgatgaacgataatttcaagacggttggattcttttacttttaattcttccgcatttcggataattgtttctccatttgcgcaggcagccataactgcaataactgggagttcatcaattaaagttggaatcagatctccttcaataacggttccatttaattcgctgtgttttacaaggatgtctgcgactggttcaccacattgcgttcttgtgttaagcaattctaagtttgctcccatttgtttgcagacacgtaaaattccatcacgagttggattgattcctacatttttgattaaaagctcagaacctggaattaaaagtcccgctgcaataaagaaagcagcagaagaaatgtctcccggaacttctactttttgagcggttaagactggttccggttcaattgttgcagttgtaccgcaggtttgaacgaaagcaccaaaagaggaaagcatcagctcggaatgattacgggataaaaatggttcggtaacactggtttttccatccgcataaagccctgcaaaaagcacacaggattttacctgggcagaagcaaccggagactggtaggaaattccctttaacggcgcacctttgatatgaagtggtgcacatccattgttatgaacactggtaatatcagcacccatcatagagagtggtgtcataatacgtttcattggacgtttttgaatcgaagcatcaccggtaaggtcgcaggaaaagttttgtccggctaaaataccggaaattaatcttgtcgttgtaccactgtttccggcatctaaaatttcttttggagcacttaaaccgtgcagtccttttccatgaaccagaatttcattttctgtttcttcaatttcaatccccattttttgaaaacaggaaatggtagagaggcagtcagcaccttttaaaaagtttgtaatcgaagtagtaccattggcaagagcaccaagcataatgcctctgtgggagatggatttatctccaggtacggtaatttctccttttagaggatgggatttatgaaataacatattgtaaactcctaacgctcataaataatatagtttcgttttctaagctgctcagaagcggctttcagggcttcttcatcgtagaaatcaatttttaaaacaccttcatcaaattcacgattatgaagaatgccaatatttttaatgctgattccgttcatggacaaaatggttgcaattgtggcaattgcaccggtttcatctacgatatcgcagtacagtgcgaattcttttttgattggaccacttgaagtgttatcaaaagagtttcgatagtctcttgaagaagaaaacatctgataaagtccattggaatctttctggtcgatcaggtattttgcctgtacaattaagcggataaattcatctaatactttggaaatgttatcagggttttccagacaaatctgctgccacatataaggggaggaagaagcaattctggtaatgtccttaaatcctccggctgcaatacttttcatgtgttcatctgaagaatccagtttttgaaccagattgacaagagaagaagcaacaacatgaggcaagtgactgattgccgcagtaatatagtcatgttcctgagcagtaagaatcataggaagtgctccaatcgagcttaccagttcgctgtaccggctgattttatccagactggcttcctctgacggtgttaaaatataataagcattttcaattaaatggtcggaagaataagcgtaacctgttttttcacttcctgccatcggatgtccgccgataaaatttgcggccatggagagtttcgtgatttctttatgaatttctcctttgacactgccgacatctgttaaaatacagcctggacggattttcgttttcagccattttaaacattcaatattgtagtctactgtggcgcagagaaagatataatcacagagcgaaaatttgctgtccatttcttcgcaggcaatgtcaacaatgccttcaaagacagcatcgtctaaagtttcccgtgttcgattgtatgcgataatctgataatctgggtggaattttttgatggctttcgcaatagaaccaccgattaacccaagaccaataaaaccaattgttgtcgtttccatgaaaatctccttcttttttcggtaatcagacaagactgatgcagtgtcgtcaaaaatgaatcaaatacggcacaagtctgtcaaacataactattttatgacatcttgaaagaaaagtcaacggtttgacgctttaaagcgctacgctgacattttgcataatgaaaaagaaagaaaatgaaaaaataccttgtctaaattgaataaaatacttgaaaaattgatttttttttagtaaaatatatacatattaaattttaggaggtattacatatggacgtttttagaagtgacagaattagaaatgtggtcctgcttggtcacggcggttccggtaaaacaagtctggtcgaggcaatggcttatttatcaggaataacaaaccgtttaggtaaagttacagatggtaacacagtcagtgattatgataaagaggaaatcaaaagaaaattctcgatcacaacttcagtagtgccaatcgaatggggaaaagtaaaaattaatgtgctggatacaccgggctatttcgacttcgtgggggaagtagaagaagcagtggcagcagcagatgcagcaattattgttgtttccggaaaagcaggggttcaggtcggaacacaaaaagcatgggagatgtgcgaaaaatataatctgcctcgtatgttttttgtaacagagatggatttagaccatgtcagctatcgtaaagtagtagaagacttaacggaactgtacggaaagaaaattgcaccgattcacatgccgattcgtgaaaatgaacagtttgttggttatgtaaacatcgtaaaacaggccggcagacgctacgttgaaagaggacagaaaaaagaatgtccgattccggattatctcgaagaatatctggaaaaataccatgatatcttaatggaatctgttgcagaaatcagtgaagaatttatggagcgttattttgcaggagaagaattttctgtagcagaagtttccgcagctctgaaaatgaatatttcagatggaagtattattccggtatgcatgggttctaccgtaaatgtacagggtgttgcaaacctgcttgatgatatctgcggttatttcccaagtccggctcagaaaacctgtgcaggaatgaatatgaaaacaaatgatatctatgaagcaaattatgattttgcaaaagcaaaatctgcttatgtatttaaaacaattgttgatccattcattggaaaatattctctgattaaagtctgctcaggtgttatcaaaggggaagatactctttataatccaacaaaagatgcagatgaaaaacctggaaaaatctatgtattacagggtggaaaaccaattgaagttccggaacttcatgccggtgatatcggtgcaattgcaaaattaaatacagtggcaacaggtgatactctttctacaagaacgactcctgttgtgtttggaaagacagagatttctgttccatatacctgcaaacgttataaaactgtgaataaaggcgatgaagataaagtatctcaggcactttccagaatgatgcaggaggatcagacactgcggattgaaaatgattctgcaaaccgtcagaccttgatgtatggtatcggagaacagcatcttgacattgtatgcagtaaattaaaagaacgttataaagtagatattgtgctttcaaaaccaaaagttccatttagagaaacaattcgtaaaaaagccgacgtagatgcaaaatataagaaacagtccggtggacatggacagtatggtcatgtaaaaatgacatttgaaccatctggtgatttagagactccttatgtatttgaacagaccgttgttggtggtgcagttccgaaaaactatttcccggcagtagaaaaaggaattcaggaatcagtcttaaaaggacctttagcttcttatccggttgtcggtgtgaaagcaactttatacgatggttcttatcatccggttgactcttctgaaatggcatttaaaacagccgcaattcaggcatttaagaaaggctttttggaagcttctccagtattgttagagccgattgtatctatgaaaatcaatgttccggacaaatataccggtgacgttatgggtgatttgaataaacgaagaggacgtgttcttggaatgaatccagatgcccagcataaaggctgtacaatcgtagaagcggatattccgatgctttcgatttacggatattcaacagacctgcgctctatgacaggaggaagcggagtgttctcttatgagtttgcccgttatgagcaggcaccgtctgatattcaggaacaggaaattaaagctcgtcaggaagaaggcgcagatgcttaaaataatttaagaaaacttaagaagatatctcgaaagagtggggctttcgggatatcttttttttcggttttgtgttacactgtaccgtaacacaaaaaaagaaaggaatttagatttatgaaaaagaaattattagcaggaattgctgttcttttgctggcatttttatattattatattgaactgcctgcaattaatatccatgaaagtggattctggtttttccttgtcgcagtaattggaattattgtggttgtttatgcaattcggaaaagactttatggaacaattcaattaaaacaaagcaaaggaatcaaagtaggtgttattttaatgcttggaatcattgcagtatatgcggtgggttctctgctttcttctccaattatcaatgcaaagaaatatcaaaatcttgtgacaccggaggaacgggattttacagaagatatccaggaaatcagttttaatcagattccgcttctggataaagattctgcagtattactgggaaatcgaaaaatgggaagtatggtagatatggtttctcagtttgaagtcagtgatttgtattctcaaattaattatcagggacagccgtatcgtgtcacaccactggtgtatgcaaatgcaattaaatggctgaccaatcaaaaagacggaattccggcttatattcggattgatatggcaacacagaatacggaactggtaaagctggaggatggaattaagtattcagagtcagagctgcttaatcggaatatttaccgacatcttcgttttcgttatccgacgtatatgtttgaccagttgagctttgaaattaatgatgatggagtaccatattggatttgtccggtaaagaaatttaatattggtttatttggcggacagactattggaaaagtggtgctttgtaatgcaattaccggtgagacagaagaatataaaataaaagactgtccgcagtgggtagaccgtgcttatccggcagacttattgattgacttatataactatcatggtacattgaagaatggattttttaatagtgtgctggggcagaaagggtgtttaaagacaaccgatggatataattatctggcacttgaagatgatgtatgggtttacaccggaattacatcagtaagtggagaccgttccaatgttggatttatattgatgaatcagcgtacaatggaaaccagatattattcctgtgccggagcagaggaatattctgctatggaatcggcagaaggacaggtacagaacttaaaatataccgcagcttttccattgttattaaatatttcaaacgagccgacttattttatggcactcaaggacggagccggtctggtgaaaaaatatgcgatggttaatattcagaaatatcaaaatgttgcaatcggtgataccatatcagagtgtgagaaagcttatgtcaaactgcttgcctctaatggaattacttcaacagatgaaaaaagtacaggaacaaatgaaatcagtggaaaaatcaagagaattggacaggcggtcattgatggaaattcccatttttatcttgcattggaagaaaacgatgaggtttatgatgtgccagtcgtggattatccggaaattgtgacttatgatgtgggagatgagattactctggaatatagtgaagattcaccggcaaatgtagttcttggaataaaataaagtggttttttggattcttacttgacaaatacaagggttctgggtagaataacaatagttaaagagagtagaaaatactctgaaacatgaaaaaaacattgaagaggaagagtacacatggttctttaatacagagagctgccggcaggtgaaaggcagtgagaagaaatgtggaactggccttggagttcctttgcagaacggaagaatttcttagtaagaaaaggcgggagttcccgttacagaatcaatgagtgcatctgtagatatagagatacagatgaattagagtggtaccacggaatgaatctaagcccctttcgtctctaaaagtttagtgacaaaaggggcttttttatttcatggtaaataatgtattctcagagtctttttatagttagtaaaggactttgaaagcgcataataacaattaggaggaaacaacaatggcagtaccttataatcataaggcaattgaacagaaatggagagaaaactgggaagcaaaaccggtaaacgtagatgacggtaaaaaaccgaaatattattgtctggatatgttcccatatccgtcaggaaatggacttcatgtaggacattggagaggatatgttatctctgatgtgtggagtcgttataaaatgatgcagggttattacctgattcatccaatgggctgggatgcattcggtcttccggctgaaaactatgcaatcaaaatgggagtacatccggcaaaatcaactgcacagaacattgcaaatatcaagagacagattaatgatatcgcagcaatttatgactgggatagagaagtaaatacaacagacccgaatttctacaaatggactcagtggatttttgtaaaaatgtttaaagaaggtcttgcttacgaaaaagaattcccgattaactggtgtccgtcttgtaaaacaggtcttgcaaatgaagaagtagtaaacggatgctgtgaacgatgtggagcgactgtaacaaagaaaaatcttcgtcagtggatgcttcgtatcacaaaatatgcagatcgtctgttatccgatttggataaattagactggccggaaaaagttaagaaaatgcagtctgactggattggaaaatcctatggtgcagaagttgacttcaaggttgatggaagagaagataacattacggtttatacaacgagaccggataccttacatggtgcaacctttatggtattagctccggaacataaactggctgcatctcttgcaacagaagaaacaaaagaagcagtagaaaaatatatttatgattcctctatgaaatcaaatgttgaccgtctgcaggataaagagaaaacaggtgtatttacaggaagttatgcaatcaacccattaaatggaaagaaagttccaatctggctttctgattatgtactggctgattatggtacaggtgcaattatgtgtgtaccggctcatgatgaccgtgactttgaatttgcaaagaaattcgatatcccgattattcaggttatcgcaaaagatggaaaagaaattgaaaacatgactgaggcttataccgatgcagttggaacaatgattaattccggtgaatggaatggcatggaatcttctgtattgaaaaaagaagcaccggctatgattgaaaaaatgggattcggaagaaaaacagtaaactacaaactgcgtgactgggtattctcccgtcagcgttactggggtgaaccaattccgattatccattgtcctcattgcggaaatgtaccggttccggaagaccagcttccattaactttaccggaagtagaatcttacgagccaacaggtacaggagaatctccacttgctgcaattgatgaatgggtaaatacaacttgtccggtttgtggtgcgcctgcaaaacgtgaaacgaatactatgcctcagtgggctggttcttcctggtatttcctgcgttatgtagataacaaaaacaacgaagaattagtttcaaaagaaaaagcagataaatatcttccggttgatatgtatatcggtggagtggaacatgcagtactgcatctgttatattctcgtttctatacaaaattcttatatgatatcggagtaattgactttgatgagccgttccacaaactgttcaatcagggtatgattacaggtaaaaatggtatcaagatgagtaaatcaaaaggaaatgtagtatctccggatgatttagtaagagattacggctgtgactccttaagactgtatgaactctttgtaggaccgccggaattagatgcagaatgggatgacagaggaattgatggcgtttaccgtttcttaaatcgtttctggaaactggctatggacagcaaagaagcaggagttgccgagacaaaagaaatgataaaactgcgccataaactggtatatgatatcacacagcgtctggaaagcttcagcttgaatactgttatctccggattcatggaatacaacaataagttaattgaacttgcaaagaaaacaggtggaatcgataaagaaacaatcgagacatttgtaaaactgcttgcaccatttgctccgcatattacagaagaattatgggcagaatacggtcacacagattctgtattccatacacagtggccgacagcagatgaagaggcaatgaaagatgacgaaattgaaattccggtacagattaacgggaaaacaaaagcaattatcagtatttcggcagaagcaaccaaagaagaagcaattgaagcaggaaaagctgcagttgcagataaactgacaggaaacattatcaaagagatttatgttccgaagaagattattaacattgtggcaaaataaaaataaataaaaatagaataagaacaaaaaggatatgatgcgtctggtgtcatatccttttttgcttttaagataatataaatggcattagctatgctgaataaaataaaaaaagaaagtatgttcgattttgctgatggttttacaattatataatatactatatgatagaaaagaaaaacattatattttatatagcttttattcttccactaattgaattcctgaaatatccggttcaataattaaggaataattggtatagtacacaacaaaccctggtttcgagccgtttggttttttgacatgttttttctgaatatagtcaatttcaacttttggagcagtccttccactggaataatatccggcaaggcgtccggcttcttcaaaggtgcgatccggcagttcttcgttgtttgattttacgataacatgagagcctgccattttttttgcatgaaaccaccagtcatttcctgttgcgaatttaaaggtcagttcttcattttgatagttattttttccgacataaatgtgataaccgtcactggaaatataatgcaaaggcttagatttggattgcattttctttttgttattcgaggtatgttttttgatataaccgtattcagtgagctcgtctttaatttgagagaggtcattttcctgtctggcaatatcaagtgcagcctgaatggattctaagtgaagaatttcagattcggtatcagcgatctgttcttcaagagcctgtgcggtacgttttaatttattataacgttcaaagtatttttttgcattttcctgaggggtcatagttgcatcaagtgggatagtaatttcctcattggtataatagtttaatgcctgaaatgacttacagccttcttcaaggttgtatccgtaagtattaatcagttcaccatatactttatatttatccatttttgtagtgtcacgcatctgtttgctttgtaaatcgaatttttttcgattacggtcaagtgcagtctggacaattcggcgcaaatcagcagacttttgtcggatacgggtaatctgatttttttgtgcataatataattctaacacttcagaaatcgtctggaattttttgacggtaaacccatcgtatttacacagtaaaaaagctgcatattctacaggttccccttcttcattataaacaatattcggagaaaagtctccatttgtaacatcttccatcatacgggcaaaggtatgataaagatgaactctggcttcttctgaaagagaagctgtcggttcacttccatcaatggagcttctagagcagatttcttcagcagcagcaggacttaaaccggtaagagaggtgtaaatcgcctttgcgacaggcattggcttttcacagacgatctgataaaattctttctcagtaattgtaagaggattttgtttttcctgtgtctgaggaataaaataatcgcgtcctggcagtacttcacgcacggaactcatgtttagagagacatgtttaatactgtctaaaatcatgcgttcttcatttaagaaaataatattactgtgttttcccatgatttcaacaacgagtgttttatggcataaatcgccaagttcatttaagtgctcgattttaagttcgatgacacgttcaagtcctggctgggtcactgctgtgatttttccgctaccaatatgttttctgagcagcatacaaaaatttggcgcagttaaaggacttggtttgtttttttcagtaaagtaaataaggggaagagaagcactggctgaaatcaaaagacgatactgagtacggttattttttatagtaagtaaaagttcgtccgcttccggctgtgcaattttattaattttaccaccgacaatggtgttatttaattcttttacgatgtttgcaattgtaattccgtcaaatgccatgatatgaactcctatctatagttagttgaacgcagataagcattcccccgcttcaagtgtgcggagcactaagcggcgggtgaggggggatgcttctgtcagtgggaattgaaagctcccactgacagatcgcgaagcgattgcgttcatgagcaagtagcgaagcggattgcgaatgtccgctttacttgttctttttattataatcgaaatacaaaaacaaagcaatgaaaaaaaggtttgactgtattatacgattgctttataataatttatgtatgtttatgccacaggcaaatataaaacaacagaaaagagtacgacatgattaagagcatgactgggttcggaagagctgagatgattgatgaagagaaaaaaattgcggtagagatgaaatccgtaaatcatcgatatctggatatcaatatgagaattccaaagaaactcagcagttttgagggtgcgatacgcggtgttttaaaacaatatatgcagcgtggtaaagtagacctttttattacttatgaggactacacacaaagcggtgtgacagtaaaatataatcgtgaaattgcacagcagtatctcgaatattccagacagatagaggaagaatttcaactgaaaaatgatatgaatgtttcaaatatcatgcggtttccggaagtacttacaatggaggaagaaaaggtagatgaagaagaactgtggacttctcttaaacaggttcttgtaaatgcggttcagccttttattaattcaaggatacaagaaggaaatcatttaagtaaagatattttagaaaaactggatggaatgtaccggaaagtagaactggtggaaaaacgttctcctgagattttaaaggaatatcgtgaaaaactggaaaacaagacaaaagaactgcttgcagatgcccagatagaagaaagccgaattgcggcagaagtgattttatttgcagataaaatttgtacggacgaagaaaccgtaagactaaaaagccatatcaatcacatgaaaaaggtactcacggaagaagaaggtgcaggaagaaaaatggattttattgcacaggaaatgaatcgtgaggcaaataccattctttcaaaagcaaatgacttggaaacttcaaatctggcaattgacttaaaaacagagattgagaaagtgagagagcagattcagaatattgaatagaggcaaaaaagatgtcgaagttaatcaacattggatttgggaataccgtaaatacagataaaattgtagcggttgtaagtccggatgccgcaccgataaaaagaatggtgcaggcagcaaaagaagaaggaatggcaattgatgcaacgcagggaagaaagacaaaagccgtgattataatagaaaatcatacattggtattgtcagctcttcagcctgagacaattgcaaaacgatttggtacattttttgaaacggaattgagaggggagcaagatggctaatcgaggaattttagttgttgtatctggattttccggcgcaggaaaaggcacattaatgaaacatttgctggagaagtatgataactatgcgctgtccatttcagcaacaacaagagcaccgcgagagggtgaagaacatggaagagagtacttcttccatacaaaacaggaatttgaagaactaattcttcaggatgcactgattgaatatgcacagtatgtggagaattactatggaactccaaaggcttatgtggaaaaacagttagaagccggaaaagatgtcattttagagattgaaattcagggtgcgttaaaagtaaaagagaaatttccggacaccttgttattgtttgtaactccaccgtctgctgaagaattaaaacgcagactgataaacagaggaacagaaacaaaagaagtaattgattcaagactcagacgtgcgtcagaagaagcaaagggaatgccgttatatgattatattttaatcaatgacgatttagaagaatgtgtggataccatgcatgaagtaattcagagtcagcacaataaatccagcaataatgttgcatttatagaaaaaataacaggcgaagtcgccgtatttgcgaaaggagaatgaatatgatacatccatcttacacagaactgatgcaggcaattaatgaaggtgtggacgtagaggatgaaccgattgtaacaagtcgttactctatcgttcttgcaacaagtaaaagagcaagacagttaatcgagggaaaagaggcaatggtttccacaagaggaaagaagccgctttctacagcagttgaggagttctataaaggacttgtaaaaattgtaccggatgagaatacagaagaagtagtagaagaaacaactgaagaagagtaaaagtcggggactgcacacaagttgcagtcctttctaccacttggagaaaattaaagtcaggattatgcgagactgaaaaaatagagatagaaacagggaggattatgagaaaagtattatttatttcccttgggtgtgacaaaaatctggcagattcagaagaaatgcttggaatgttagttactcatgggtatgagattacaaacgatgaaacagaagcaaatgttgcgattatcaatacctgcgcatttattcatgatgcaaaagaagaaagtattgcaaatattctggagatggcacgctataaagaggaaggtcagttaaaagttttattaataaccggatgtcttgcacagcgctataaagaagaaatcgttaatgaaattccggaagtggatgccgtgcttggcacgactagctttgacgacttattagaagcaatagaccaggcatttggcggagaacgttatctggaatttaaagatatttcttatacaccgcaggtggaaacaaagcgtatgattacaacaggcggtcattttgaatacttaaaaattgctgaaggttgtgataagcactgtacttactgtattattccgaaacttcgtggaaactaccgcagtgtgccaatggaaaaactgttaaatcaggcacgttatcttgcagaacagggtgtaaaagaactgattcttgtagcacaggagacgacggtttatggcgtggatttatatggagaaaaatcacttcataaattgttaaaagagttatgtaaaattcccggtattgcatggattcgtgtactttactgttatccggaagagatttatccggaactgattcaggtcatgaaagaagaaagcaaaatctgccattatctggatttgccgattcagcatgcaagtgatgccattttaaaacgaatgggaagacgcacaacaaaagcagaattaaaagaaattgttggaacgctgagaagagaaattccggatattgtgcttcgtacgacgttaattaccggatttcctggagagacaccggaaaatcatgaagaattaatggaatttattgatgagatggaatttgaccgccttggagtttttacttattccgcagaggaagatacaccggcagcatccatgccggaacaggtggatgaagaagtgaaaaaagacagacaggcagaactgatggaactgcagcaggatatttctttagataaaggaaatgaaaaaattggacgagacatgcttgtcatgatagaaggaaaagttgcagatgaaaatgcctatgttggacgtacttatggagatgctccaaatgtagatggttatatttttgtaaatacagatatggaactaatgtctggagacttatgtcaggttcatgtaaccggagcactcgaatatgatttgataggagaactgaaagatgaatacaccgaataaacttacaattgcccgtgtgattatgattccgttttttgttgcatttttgatgtatgatattgcaggagatgcaggaaaatggatcgcacttgttatttttattgctgcaagtattacagacaccttagatggctatattgccagaaaatatcatttggtaacgaattttggtaaatttatggatcctttggcggataaattattagtctgctctgcattaatctgctttactgctacaggtaaacttgcagcatggatcacgattattattattgcacgtgaatttattatcagtggttttcgtctggttgcagcagataacggaatcgttattgcagcaagttactggggaaaatttaaaacagtatctcagatgattatgattattttaatgattatggatatccaaaatggagcattccagactctgattacggtatttattgttattgcagttgcactgactttaatttcacttgcagattatattatgaaaaataaacaggttttaagcatgcaggattaaatttagaagttttataaaaagatggcatccattgttcttttctttaatggatgccatctttttttctaaattatttaacaaaatcaaggaagtcccctgcttcaattgcaaaaagcaataagcatgggtggggacttgcttgtatcaggaggggggcaagccccttctgataagctgcgtagcagctatttggttatgagcaagtagcgaaagcggattgcgaatatccgcttgactactgcatcatttttataagctgtaatatacgctcaattcgggcggtctcttcaggggttttattttgctttaaggcttctatgatgcagtccatttcttttgaggtaaaagaaagagttccggattttttttgagtgtttgataaggatgacaccaaaaaaggaagaagctcagacattcctttttgacttccctgattggcaattgaatttagcatctgtaattttaaagggtcaattccgtttacattgtcagatttcatccagtcttccggcatagtttgcacctcctatcttgtaaacttttcttgagacaattcaaaaatttgaatcattgccattgtatttaaaagggtatcaattttttcttttgcagggccgtggcagactttactgcacgccgataacatttcaattgggtctttgggagtaaaatcctgagtctgcatttctccttgaggttctaagaaaacatgaaaagtttcttgaagttctaaaaatttggcaaaaacagaagcaaactgctgaccgcttcttggaagataaggcatagcagcttttaaaagttcaatctggtcggaatgaattaattcatcagatggagtagattccataaacgcttcctccataagggaaacactttttttagtttatgaaaaaaaagcagagaatattccaacgaaacatcataaactaaagcaaagacaaaaaaaggagactgaaggatggaaaaatcagaaataaaaaccagattagtggaagagaataataccatttatgaaatagatttggactgtttaaaaagaaaagaacagagaaaaaaagagaaaaaagaagataaaaaacgttctcaaaagataagaaattaataaaacttcatacagaaaatgagctgccgcaaaaacggcagctttttaaaatagtagaatgaacagtaagaatcagcagaaattatttccaccgcatccgcataacagaagcagtaagatgataatacaattgcagtcatttccataaccattgtgttgtccgcaaccacatccattattgccatttccgcaacagcataaaattaaaagaatccagataatagagttgcagtcaccaaaacatcttccaagtccacatccgctgtttccggtgcaggaatcgtcgcatccgcatccacagtttgtagcagctaaatcactcatattgttcctccgtaaggattttgattacaatttcatcttatgtaggaaatgaaaattggtgcatgaaaaaattaaaaagaggcaaaggtttgaaaaatttgatagatatcaagaatgcccaatccccattcccgattgggataaatccgatcttcacttcgccgtgctccacgaattaaaagagcggtcagttccgcagtattaaaaattttaggaggcattcttttttgtgcccattcgactaaaagagcacaggcacctgcagtaagagcacaggcagcagaagttccggtaatcgttgtataggtgttttggagagatggagcagagacattgacaccaggtgcagttaagtctggttttatctcttcaagtctggtaaaacctctgcttgaatttaaaaacaggctgttgttgtaggcactataggcagatattgtaataacataaggagaagtggcaggctctgtgatagtggtatctgggtttggacgcaggaagataacatccggagaaagaaaaccactgattggaagccataagtggaaagaacctttattttgatttctggcatagactcgtattttccagatcccaggagtgggggctgaaaatcgcatgaaaataaactgctcacctgagacattttgaataacagaagaagaaagaaaaatctttgtatcttctagaataaaatccagtgtttcacgaaaattaacacgggaaggaatccgagaaatgatttcacctaaaggtgattcaaaaccaacttcatagatttcaggagaatctccccataattccagcgtaaaaccagaggaatttgccggaacagaaagttcaacagggatataatcctgtggcatgggtgcataagagaaaaaatgatgggcttttccggcttcatttccggcggcaatcacaggatagaagccccagtagttagaaagttcggtaaacattttagcgagataggaacgaccagagtgtgcaccttgatttgtgccgagaccaagacagaggacaagaggctttttttgttctcgggctaagagtgtgaaaaatcggattgccatcataatatcggtctcttgaaaaacaggttcattgctggtatggtaaaaaatttctcttaaatactgcttggctggttttaatttgaccaccgcaatctgggagagaggtgctgcgcctgaaaaatcctgttcagggatagaacttccacaagcaatcccggcaagtgctgttccatgaccaatctcatcattagaaggaacaacttcaaatgggttggaagaggagagtgcttgattgatgtcttcttcaaagtaaacgcttccataagaaaggtcaaatggaggttgtccggtttgaatgttctgatcccagagtgcaagaattcttgtacgcttatcacgggttaaaaaagcagaatgagtgtaatcaactcctgtatcaataaagccaacaattacatttcgtccttttaaatcaagagaaggctggttttgtaccgttaaaatgccggaagattccagactgacaaggttaagcaaagaataaagtttgggcaaggtggtatagcgcaactcatcggtttccagataatttattaaattttcggatggacgtcggctgtgaatcataaccagatggctgttaaaaaactgaattccatattcactaaaatcttgttcgatcccatcatagtaagggagaataaaatccagatattcatctgagaggataacatcacgtaaattttccatagacataaaatagaaaactccttttgtttcaagtgtttaatatatatgcataagttgggaacaaaagactttttagaggttatatcataatatagaattaagaaatcgggaaatggagtttgatatgctgacaggaaaagggattggtgtggcgatgcttgataccggaatttttccacatattgattttgcaggacgaattttggcatttcaggactttatttatgatagaaagactccttatgacgacaatggacatggaacacatgtagccggaatcctgggaggcagtggagccgcttttcaggggaagtataaaggagtagcatgtggatgtaatttaattgggattaaggtattagacagaaatggaaatggagaaaaagaaagcgtaatccggtcattagactggattcaaaaaaacagaaaccgctatcagatacgaatcataaatatttctgttgggacaacacagaaagaagaacataaggatttaattgatgcagtggaaagggcttgggatacagggttgattgtggtggcggcagcaggaaatatgggaccaggagaaggcagtattacagccccgggaagcagtcgaaaaattattacggtggggtcttcggatttacttgtaaaaaacaggggaattagcggaagaggaccgacaaatgactgtatcatcaaaccggatgttgtggctccgggaaatgctgttatttcatgtgcgaaccgcaatgacaatatgccttataccataaagagcggaacttccatgtctacccctgttgtttctggcgctattgctctgcttttagagagagaaccatggcttacaaattttgaaattaaaaaaagattaagaagaactgcgaaggatttgggatatccgcataacttgcaggggtggggactgtttgaagtgaaatcatttttaaatgaaaataatggttgacaaattctgtatcattgtatacaatgatacaagaagtttgatacagcatcgctttatcaagagaaaacacagattgaggagtgaagaaaatgattaacagaagtgtccgaatgaattatcatacaaacttactggaactagaggagcatatgtatccgttagtagatgtggagacaccgaatgtctttcataatctgtttccatatacagaaataccgaaaatagcgtttaatgaccgtattgtaccgcatcacatgccggatgatatctggattacagatactacatttcgtgatggacagcagtctcgcgcaccatacagtacagaacagattgttacaatttatgattatcttcataaattaggtggagaaaatggaaaaattcgtcagagtgaatttttcttatacagcaaaaaagacagagacgctgtttataagtgtctggagcgtggttataaattcccggaagttacaagctggattcgtgcaagcaaaaaagattttgaactggtaaaagatttaggattaaaagaaacaggaatcttagtcagttgttcggattatcatattttctataaaatgaaaatgaccagaaaacaggcaatggaacattatttaagtgtaattcgtgaatgtctggaaaccggaatcagcccaagatgtcatttagaggatattacaagagcagatatttatggatatgtcattccattttgtctggaactgaccaagttgatggatgagtattctattccgattaaggtgcgctgctgcgatacaatgggatatggggtaaactacccaggtgcagtaattccacgttcaattcctggaattatctatggtattatgacacatgccggatttccatcggaattaatcgagtttcatgggcataatgatttttataaagcagtcagcaattcaacaactgcatggctttacggagcaagcggtgtaaactgttctttatttggaattggagagcgtaccggaaatactcctcttgaggcaatggtatttgaatatgcacagttaaaaggttctttggatggaatggatacaactgtgattactgaacttgcagaatattatcagaaagaaattggttataaaatcccgccacagactccgtttgtaggaagtgcatttaatgttacccgtgcagggattcatgcagatggtctgttgaagaacgaagaaatttataatatttttgatacaaagaaatttttaaataaagcaccgcaggttgcagtatcaaatacctcgggtcttgcaggtatcgcacattggattaataatcactatcagctggaaaatgaaaaagcaatcgacaaaaacagtgaactggttgtaatgattaaagcgtgggtggacaaacagtatgaggatggacgagtaactgtactgaccgatgaagaattaattgcagtgattgaagaaagttgtaagagattaaatattgagctttaaaataaaaaatgtacttttagagtcgaataaagattctgaaagtagataaaacaaaaaaggagaaaagatggcaggaacagagaagtctttaagaggacaggtttttgataaaatacgttccgatattttgaatggaaaatataaaagaggggaagaactggttgaaagttcaattggaaaagaattgggaatcagccggacgccggtaagagaggcaattcgacagctggaactggagggattggtacagcttgttccgaataagggggcatttgtaaccggaatttccgaaaaggacgtaagagatatctatctgattcgtgcacgcttagaaggtcttgctgcaagaatggcagcaaagaacattacaccggagcttttagatgcgatggaagagacggttgtcttatcagaataccatgcgaaaaaagaacattatgaacaggtatgtgagatggacagtaaatttcataaacttttatataaagcatccggaagccggattttagaacatacattaacggattttcatcaatatgtgcagagagtccgaatggcatccattatgaaaaaaagacgtatggaaaagtcaaatgacgaacatgatgcaattttaacagcaattcgtgagcacgatgaggaaaaagcggaattagtggcaactcgtcatatttcaaatacagtagaaaatttaaaaaactatgatttagacagtgtattaagtaagggcgaataaacgttagggcttaaggaggataagacgatggaaaaaattaaaatgacaacaccacttgtagagatggacggagatgaaatgacaagaatcctctggaagatgataaaagaggaattacttgagccatatattgatttgaatacagagtattatgatttaggactggagtataggaataagacgaatgaccaggttacaatagatgctgcaaatgctactaaaaaatataaagtagcagtaaaatgtgcgacaattactccaaatgctgcacgtatgaaagaatatgatttaaaagagatgtataaaagtccgaatggaacgattcgttccatgctagatggaacggtatttcgagctccaattgtcgtaaaaggaattgaaccttgtgtaaaaaattggaaaaaaccaattacattggcaagacatgcttatggagatgtctataagaatacagagatggtgattcccggcccgggaaaggtagaactggtttatacaagtgaagatggaacagaggtaagagaactggttcataattttgcaggtgcaggtgttgcacagggaatgcataatttaaatgattccattgagagttttgcaaagagttgttttggttatgcactttcaaccaaacaggatttgtggttttctacaaaagatacaatttctaaaaaatatgaccatacattcaaagatatttttcaggaaatttatgaaaaagaatataaagaagcgtttgagaaagccggaattacgtacttttatactttaattgatgatgcggttgcacgtgttatgaaagcagaaggcggatttatctgggcctgcaagaactacgatggagatgttatgagtgacatggtatcttctgcatttgggtctttggcaatgatgacttctgtattggtttctccgaacggttattttgagtatgaagcagcacatggtaccgtacagcgtcattattataaatacttaaaaggagaagagacttctacaaactctgttgcaacaatttttgcatggagcggagcacttagaaaacgtggagaattagataaaaatgaagagctgcaggcatttgcagataagctggagaaagcaacaatagagacaattgaaagtggagagatgacaaaagatttggcattgattacatcaattgaaaatccgactgtattaaacagcaaagaatttatccttgcaatccgtaataatttagaaaaataaaaaatttagaatgaaaaagggaagagggcattatgccaactcttcccatttttcatataattcttcgagttctaaagtgatttctgctttttcattggataaagcaacacattttgcaacatcaacagccacttccggtttggacatttcttcatcaatttcgctgtctctcaattcaagtttttcaatttctgcttctgttttctttaaatcattttcgcgttttcgtttttgagcctgttcttctttttgctgtttccagtctgatttattagaagattctgtttgaacagcgatggtttcttcttgaatgtccggcgcataaattttagtcagttcttcgcgcttttccatataatagtcataatttccaatataattgaccagattatggttggttaaatctaaaattctggttgcagttttattgataaaataacggtcatgagaaacataaagtaccgttccggtatagttattaagcgcttcttccaagatttcttttgaaacgatatctaaatggttggtaggctcatcgagaattagaaaattggcctctgataacatcagtttagcaagagagacacgtccacgttctccgccgctcaaagagctgatttgcttaaatacatcatctccggtaaaaagaaaagcggcgagaagattccgaatttcagtattggtcagtttaggataatcatctgaaatttcttcgaagattgttttttccatatgcagaacgtgatgttcctggtcatagtaaccaatatgaactttgcttccaagagtaaaagtcccgctgtcagcaggaatcacgccatttaaaatttttaaaatagttgttttgccggttccattatttccaatgattgcaacgcgttctcctcttttgacagaaaaacttaaatcagaaaaaagtgggagatttggaaatgatttacttaagtcttttacatcgagaacatcatttccactggtaatttttggttcgagacggattttcatagaagcgtttaattcacttggtttttcaagaacttccattttatctaacatcttttcacggctctctgcacggcggatagatttttcacgattaaactgttttaattttgtgatgacttcttcttgatgcttgatttcctgctgttgattcatgtaagcctgataagcttcttttcgaagcattgctttcttttcactgtatgcagagtagtttccggaaaaagaagaaacttttccgttatctatttcaattactttagatacaattttatcaagaaagtaacggtcatgagagacaattaagacagctcctgcatagtttaaaagataagtctccagccaggagatagaatccatatccagatggttggtaggctcatcgagaagtacgatatcaggtttggataacagcagacgaccaagtgccactcgggttttctgacctccggagagagttgaaaccagtttggaaaaatcactttccgcaaagcccagaccctttaaaacaccggttaattcgcttttataagcgtatccgttttccaattcaaaattatgggttaagcgggaataagtatccataagccgttctaattcatcagccttagcgtatttcatctgtttttctatttcacgcatctgtagttccatatcaagaatatgctgttttacttgaagtaaagagtcataaattgttaaatctgtatctaaatcctgatgctgtgccagataaccaattcgttttcctttagcaagaatgacttctcctttatcagtgggaagctcctgcataataatgcgcagtaaggtagttttgcctgcaccgttaattccgaccattgcagctttttcatggtcttctatatgaaaagaggcattttggattaaagttacgcctccgaatgatttttctatattttgacatgcaagtatcataagttcctccttaaaaaattctacttatctgtaaaaaaaaacgccattgtatttattatatcgaaaaaaatgaattttacaacagataaatgcggcaattaagagaattgtatttgactttattttaacaattatatataataaaagtaaatttgttttgtattgaaagaacgaataatcaggcaaaaggagggtaaagtcgtggacgaaaaaagtatatcgaaggctgtaatcagaagacttcctcgttattatcgatacttgggtgaacttttagaagagggtgtggaacgaatttcttctaatgagcttagttccaagatgcatgttacagcatctcagattcgtcaggatttaaataatttcggaggattcggacaacagggatatggatataatgtaccttatctttatgccgaaataggaaaaatattaggtcttgaccgaacccatcatattattattattggtgcaggtaatttgggacaggcacttgcgaattatgtaaaatttgaaaaaagaggatttaaggttgtgggaatttttgacatcaatccggtgttgaaaggaatttccattcggggaaatgaaattcgtatgatggatgagcttccggagtttttaagagagaatgatgttcaaattgcaacgcttactctgccgaaagcttatgcggaagagactgcaaaccttcttgtggagaatggaattaaggcaatttggaatttcgcacatttggatttggcagttccggaagatgtcattgtggaaaatgtgcatctgtccgaaagtctgatgcgtctgtcttataatctgaatcggtataatacagaacataaaaaagaatgatagaagaactgctgcgaaaaaatatttcgtagcagttttttgatatttttaaaacaaaaattgggggtgactttatgagagaattcgtatccggaacacagatgaagcaattagatagatatacgatacaggaaataggaattccatcactggtgttaatggagcgtgccgcaagaagtgtgtatgatacaatgataaaagaaagacttccgcttaaaaaagtacttgttttatgcggaagtggcaacaatggagcagacggtgtggcgcttgcaagaatgctgcatctttcaaatatttcggttgatgtggaaattttaggaaacccatcgcattttacgacggagatgaaacagcaaattgagattgcaaaaaaatatcaggttgcgtttgtcaagaataaaagcctgtctgaatatactactatagtagatgccatctttggggttggattagaccgagaagtaggtggaggttacaaagaaaaaataaaagaaattaatcaggcagatgccaaagtagtggcagtggacattccatcagggattgattcggcgacaggaaaggtacttggatgtgccgtttgtgcagactggacggtcagttttgcttatgaaaagctgggaactgttttttatgaaggagcagagtatgcaggaaatgtaagagtggcagatattggaattgtaaaaatgcctgaaatttgttttccgatttcaacttatacgtttgaagaaaaagatttgaaagaaaaattatttcgcagagaaagcggaaataaaggaacgtttggaaaagtattactaatagccggaaatgagatgaccagtggagctgctcttttaagtgcctcttcggctctgcatacgggagttggaatggtaaaagtgcatactcgaaaagagaacagggcaattcttccggtacagcttccggaagctatgtattgcttttatggcaaaaaagagataaaatcagaagcgttggcagaaagtctggaatgggcagatgtagtagggattggtccgggtcttggaacaaacaaacaggcagaagcattgttagaatttgttttgaaatattctaaacgaccattggtgattgatgcagatggattaaatttattaaaaagtaaacttgatttgcttgaaaaatacgagtatcctgtaatcatgactccgcatctgggagagttttcacgtttaagtggactttcaattaaagactggaaacaacagccgatagaacttacaaatgaattggcacatcgttataatgtaactttggtttgcaaggatgcacgcaccgtaattgcagatggcggtcaaaatgtctatgtgaatacaacaggaaatagtgggatggcaactgcaggaagtggcgatgtgctgacgggaattttactcggattgctggctcaaggctatgctcctttggatgcagctgtaatgggagtatgtgttcatggtctggctggcgatgaagctgcaaaagaaaaagggaaatatgcaatggtggcaggagacctgattacttatacaggagatgtgcttaagaaaagaggataagagattatgaatagaccaagtagaatttatgcaacaatcgatttagatgccgttacatggaatttggaaaatatgaaaaaaaatataagtaaagatacaaagattattgcagtgttaaaagcggatgcctatggtcatggagctgttcctatcgcacagcatattgaatctttgtcttatatttggggaatcgcagttgcctgtgtggaagaagggatggaacttcgtgaggcaggaattaaaaaaccaattcttattttgggttatacttttgcagaagattatccgacgattatcgagcatgacatgagaccggcagtttttacatttgagatggcacagcatttatctgatgctgcggtaagaatgaatcaaaatgcaaaaatacatataaaagttgatacaggaatggggcgaattggctatcgggatatcaacgaggcagttcctgaaattttaaaaatttcaaaacttccgcacattgaagtcgaggggatctttacccattttgcaagagcagacgaagcagaaacaacaccggcttatgtgcaattagaaaagtttcggcagtttatttcaagactggaagaagaaggactttcaattccgatgaagcattgctctaatagtgctggaattatccgtatgaaagaggcaaatatggatgccgtccgtgctggaattattttatatggcttatatccatctgacgaagtggaaaaagaaccggttgctttaagaccggttatggagttgaaaacacatatttcttatgtgaaaacagttgaaaaaggaaccgcaatcagttatgggggaacatttataacagaaaaagaaacaaaagtggcaaccattccggttggttatgcagatggatactgtcgtggattatccaataaaggatatgtactgatacatggaaagagggcgccgattcttggaagagtctgtatggaccagtttatggtagacgtaacagagattcaggatgcaaaaattttagatgaagtcactctgcttggaagagatggaaaagagaaaattacattagaggaattaggtgacttaagtggaagatttaattatgagtttgcttgctgtatcagtaaaagagttccaagagtctatctggtaagccgttagaatcttctttgagatttatggcaaaaagccagtatttccatagaaaatataaaaaccatagaatacacacgaaagaattgggaaaaatgataaaaaggtgtttgaatgcagataagcattcccccgctttaagtgcgcgcagtactaagcggcggctgaggggggatgcttatgtcagtgggagttgaaaactctcactgacagattgcgaagcgactgcgttcatgagcaagtagcgaagcggattgcgaatgtccgctttactagaagcaggagtcttattgactgagatagaaaacacagaaaaaaatcggagagtgaaaacgtgtggtaattaaacgtggtgatattttttatgcagatttaaggcccgtggtgggaagtgaacagggtggtgtccgccctgtattgattatacaaaacgatgtgggaaataagcatagtccgactgtgatttgtgctgctattacatcaaaaatgaataaggcaaaactgccgacgcatattgagattgatgcttcttcctatgcgatagtaaaagattcggtaattttgctggagcagcttcgtacaatcgataaaagaagattaaaagacaaggtttgtcatttggatgcagagattttacagaaagtcaaccatgccctgtgtgtgagtctggagctgcctacatagtgaaaaaatcttgacgtgagaaaaggaaaatggtatcttattgtagaatagctctgtgaaaaaagggcaatctgagacaagaaagagggaatagagaaattttatggacgacgggagtagtcctttatggacaggaatcgttttgattttatttgttatcataaacggaattttgtatggatttggttccgccatacagaaggtaagtgaaagtgaaattgaaaaaaaggcacaggaaggtgatgaaaaatcacagtggcttttaagtgtgattgattcaccggcacgagtgattaatacaaccttaatatcgagtgttttttttgctgtattatccggttatgttggaattcacaaaattgtgccggcacttgaagatgtgctgagaaatattgatttttttgcttctatgtcaaagaaggtacaggctgttttgtgtgcggctttcgtattatttgttatggtggggatactagtggcaattggaatgatttcttttaagaaagtttccgtaaaagagcctatgaagtgggtttatcgaacagagaaaacagttaaactgcttattacattatttacaccacttacgttttttacgattaaactgtcaaatgggtgcgtccgattatttggaattgacccacataaatcagaagaagatgtgacagaagaagaaattatttcgattgtggatgatgcgcatgaacagggtgtgattgaagaaagtgaagcagaaatgattcaaaatatcatagagttttctgataaagaggcgcaggatattatgacacatcgaaagaacattaatgcgattgatgaaaaaacgccgttaaaagaggcattgacgcttatgttaaacggcagtaattcaagatatccggtttatcgggatgatattgatgatattattggaattttgcatttgaaagatgcaatgaaagagatgatgtttgagaatcatgccgaagaaacagttggaagaattccgaacctgattcgggatgcttcttacattccggaaactcgaagtattaatgatttatttaagcgcatgcaggcaaagaaacttcacatggcaatcgttgtagatgaatatggccaaacatccggtattgtaacaatggaagatatcttagaagaaattgtaggaaatattttagatgaatatgatgaagatgaccattttattattgagcagttagataatacatatcttatgaaaggtttaactccgcttgaagatgtagaagaaacactttcgattgatttacaggaagaagagtatgaaacattaaatggttatctgacctctcttttgggacacattccgaatatcgatgaagataaagaaattcgggcaaacggttatctgttcaccattcttgcggtggaaaataatacaattcaaagagtaagggtagaaaaactacctgaagaaaaaggagaagagaaatgtcaggacattcaaaattcgcaaacataaagcataagaaagaaaaaaatgatgccaaaaaaggtaaaatttttactgtaattggtcgtgaaattgtaatcgctgtaaaagagggtggtccagacccgaataacaacagtaaacttcgtgatgtaattgcaaaggcaaaagcaaataacatgccgaatgatacaatcgacagaggaattaaaaaagcagcaggcgacagtaacgcagataattacgaaagaattacttacgaaggatatggtccaagcggagttgcaattatcgtagaaactttaacagataataaaaaccgtacagcgggtaatgtaagaagtcatttcacaaaaggaagcggaagtattggaacaccgggatgtgtttctttcatgttcgatagaaaaggtcagattatcattgataaagaagaatgtgaaatggatgcagatgatttaatgatgattgcactggatgccggagctgaagatttctcagaagaagaggacagctttgaagtattgacagacccagatgaattcagtgcagtgcgtgaagcattagaaaaagaaggaatcccgatgatggaagcagaagttgccatgattcctcagacttatgtagagctgactgatgagcaggatatcaaaaacttacagagaacattagatttattggatgatgatgatgatgttcagtatgtatggcacaactgggatgaataattttatctaaaaagattacatgatactaaaataaaatgcgcataatacctccagaaatttaatttttggaggtatttttttatgtcggaaacagaaaaaaaacaaatatcagaaaaagaagaaactcaaaatgaacagataagagagatggggcagatactgcttgaggaaaacaaacagaattatcggattcatctgctaagtatcattggagaagtagaggggcatgaggtattgtctgcaaacagtaaaacgacaaagtatgaacatgtacttccaaaacttgctgaaatagagaatagcagcgaggtagatggagttttaattctacttaataccgtaggaggtgacgtggaggcgggtctggcaattgccgagatggttgcctctatgagcaaaccaagtgtttctctggttttaggaggtggtcattcaattggagttccgatggcagtttcagcagattattcatatattgttccttctgctactatgatgattcatccggtcagaagtaatggaatgtttatcggagtaatgcagtcttataaaaatattgagaaaattcaggaacgcattacggaatttgtggcatcccattctaatatgggaaaaaatcgaatggaagaactgatgctggataccacacagctggtaaaagatgtcggaacaatgctggatgggaaagaagcagtaaaagagggattgattgatgaagttggagggatttcgcaggcattttacaagttatatgagctgattgaaaaatcgttggagataaagtaagaaaaataaaaattatagagagttttacattgtgcgaaagtagattttatgataaaataaatgttcgataaaagaatgttcccatttgttcaaaaagaacagaatgggaaaatacataagatatgaggttgtttttatgtcatatatacaggcatttttattgggaattgtacagggaattactgaattttttccagtgagcagttccggacatttagtgattttagaaaatctttttggaatgaaaatacagccatcggtgttttttcatgtgattttacacgccggaacactggtggcggttatactggcatttaattctgatgtaaaaagactgatattggaattccttcgattggtctatgatatttattataatatcagaacaggaattcataatggatggaaacagagtggaagacgctatcgaaagctagttcccaataattacaggaagtttatgcttttattaattgtgtctagtgttccgacttttattattggaatgctgttagaagagtcagtaagagtagcgtcagtaaatttgcttgcaccgggaatcggactcttgattacgggagttttgttgtttattgcagatttctttccaacgggaaataaagtgccaaaagaagtcagttatctggttgcggttattataggtgtttttcagggatttgcagtgttgcctggaatttcacgtgcaggagtgacgattgtggcttgtctgttatgtggtttgaatcgaaaatttgcaatccgttattcgtttttgctgtctataccggctgtgattggcgcagtggtgcttgaaattgtaaagctcaatccaagtgaattctcagcaggaatggcaggaatgagtgtactgggcttcattgcagcagctgtgacagggtgcttttgtattaaaatgatgttaaaaattgtaaaaagaaagccatttcgtcgttttagtgtatattgtttctttatggcagttctggcaattatctgcagctttgctttataagaaaaggcagtgtaaaaagggagtaatgtagatggcagcatcgaaaaaagcaaatttaggtaaaacaaatttagaaaaaacgaatcgaaataaaacaagtaaaaccaataccggtacaaattcaggcagaaccaatacacataaagggaatacagataaaagtagtttaacaaataagaataaaacgagggcaaataaaacaagtacgaataaagttcaaagcgaaaaaaacggaacaggcgagacaaaaagagcagaaaaaaaaggcatgccggtcagaaaaaacagaaaaagttctgcagtttccgagaaaaaaacagaaacaaaaacggaatctcaactttatacagagatttttctttggattttagttgcagtttctattttgttaatgttaagtaattttggagctggaggcataattggaagttacatcagtaatttattttttggattatttggaattgtaacttatgtttttccggtgttcttattctttgtgactgcttttatgatttcaaacagcaaaaatccaagagcatatcgaaagatggttggatttttgttgatgtttgtagcggtttgcgcttttatgcagctattgacagatggatattatgagggaacgacattagaagaatattatcggatatccgccttgtcacaaagtggtggcggagtattgggcggagcgatctgcaatgtaacggcgaaagcatttggagtagccggtacttatgtgattttagttgcctctggaatcatttctgtggtacttgtaacgcagcaatctatgtttgaactgatgaaaaaaagcggaacaaaaatgtacgcaaaggtaaaattggagcaggaaagatgggaaaaacaaaaggcagctcaggagacagaaaattcagatgaactccagcttcagcagcacaaacagggagcaaagcactcaaaaattgccgatggagttacaaagatggcagcactttcaaaatcagctttaaagaaaaaagaagaggaagaaaaagagccaataaattttgacgatttacatgaaacagaagaaactgagtacattaaaaatatagaacaagaagaaaaagagggatttactcctcaaaatgcatttccaatccacagagccgaggaagtggcattgtgggatttagaagaattgacgataccaaagaaaacagaaaagaaacaacagaaagataaggaaaaagaacctgaaaagaaaaagctttcatctgtaaaagaaaatcagcagataaaagtacaacaaaaagaagcaccgccggccgtatatgaatttccgccgattacgttattgaaaaaaggagtgggaaatggtggtgactcagatgaccatttacgaaataccgcaaaaaaattgcaggaaactctgcacacatttggtgtaaatgtaaccattaccaatatcagctgtggacctacagttacgcgttacgaggtacagccggagctgggggtaaaagtaagtaagattgtaagccttgcagatgatatcaagttaaatcttgctgctaccgatatccgaattgaagcaccgattccaggaaaagccgcaattgggattgaagtaccgaataaacaaaacagtgtagtgatgcttagagacttaattcagtcagaggcgtttgtaaaatcaaaatccaagctggcatttgcggctggaaaagatattgcaggaaaaccggtgattgcagatattgcaaagatgccgcatcttttgattgccggtgcaactggttcaggtaagtccgtctgtattaatacattaattatgagtcttttgtataaagcttctccggaagaagtaaaactcattatgatagacccgaaagtggtagagttaagcgtctataacggaattccacatcttttgattccggtagtaacagagccgaagaaagcagcaggtgcgttaaattgggctgtcgctcagatgacggaacgttataatcaatttgcagaatacaatgtacgtgacattaaaggatataatgaaaaaatagaagtattaaatgcaaagaaaataaatcaggagacggaaaaactcttgaaaaagatgccgcaaattgtggtaattgtagacgagctggctgaccttatgatggttgccccgggagaggtggaagatgcaatctgccgtctggcacaacttgcacgtgcagcagggattcatttgattattgcgacgcaaagaccatcggttaatgtaattactggtttgattaaagctaacatgccatctcgaattgcattttcggtttcttcaggcgtagattcccgaacgatcatcgacatgaatggggcagaaaaactgcttggtaagggtgatatgttgttttaccctcagggatatcagaaaccggcacgtgtacagggcgcatttatcagtgataaagaagtatcagcagttgtaaaatttctttcagagcagacaaatggacagtatgaccatgaaattgagaaacagattaatactttgaaaggaacaaaacaggaagaagcttctttagaggctaatgagagagatgtttattttgcagacgcaggtaaatttattatagaaaaggataaggcatcgataggaatgcttcagcgtgtgtttaagataggatttaaccgtgcagcaagaattatggatcagttatgtgaggcaggagtggttggtcaggaagaaggtacaaagccaagaaaggttcttatgtccatggaacaatttgaacaatatatagaggaatatctataatggattttggcctgcatgattttattttagttgaagattgagataaaatcatgcagggcgagaaagaaaagaggttgtcttacatgaaatgtgcaaattgtggcacggaactaaaagatggaacattattttgtccggtatgtaaaagtgaaatacaatgggtgccggaatatcatacattggagacgattctgcttcaaaaacaaatgcgggagaaaaatttgaaagaaaaaaaacaaaaaaaggaagaagaactgcgccagaaaaaacgtcaggaagaaattcggaagaaaaaacggagaaaatatcaaatattcggagggagtattgctgccttgattttattggcaggtgtggcaggttttgcaattaagcggaaagaatataattcgtttgacatgcagatggcacaggcggagtcagaagtgacaaataaaaattatgaatctgctttaagctatctggagcgggcattggaattacagccggacagtacatcagcaaaaattctgcaggcaaaaatttatacagtaaacggagaggaagaaaaagcacttcctattctttcatctgtaatagaaaaagaacaggataatgtaagtgcctatggagaactgttgagactttatgaaaaacagaaagattatgattcgattaagtcacttttagatgagtgtgataatgaaaaagtgaaatcacgttacgaagattatgtatgtgaagtaccggtaatttctttaaatggtggaacttacgagaaagaacagaggattgatttcactgccatgaaatatggaacaaaggtttattatactttggatggtagtgaaccagataagacaaatggaacacgttatgattcagactatggaattgttttatcagaagaaggagaatacacgttaaagtatattgcctataatgctaagggaatcccaagcgaaaataaagaagaagtttataagattgaatttaaagctccggatgcacctaaaatcacaccggattccgggcaatatgaaaaggcgacaaaaattcgaattgcagtgccgagtggctgtactgcttattatgcatttgatgatactgtgacgacagaaagtacaaggtacacaggaccggttgaaatgccagagggtgaacatattttttccgcaattttggtgaataaaaatggaaaaattagtttgactgcaagtgaaacgtatgtcttttaccagtgagaaactaggtttttttgtatgtttgaggaaaagtacgattttttaattgaattttgatgaaaattggattatactggttgatagcaatcatagcaataaaatattcccttttgggaattgtgaggaggacaatatgtacaagattctgaaagcagaaaagctgaatgaggttatttatctcatggttgtagaagcaccacgtgttgcgcagcactgccagcctggtcagttcattatcgtaaaaaaagatgatgagggtgaaagaattccgctgacaatctgtgactatgacagagaagcaggaaccattacaatcgtattccagccgattggagcttctactacaaaatttgcacagatgaaagagggagatttctttgaagactttgttggaccattaggatgtccatcagaattagtagaggaagatttagaagacctgaaaaaagaaaaaattttatttgttgccggcggtgtaggaaccgctccggtttatccacaggtaaaatggctgcatgaacatggtatcgatgccgatgttatcgttggtgcaaaaacaaaagatttaattattcttgaagaagaaatgaaagctgttgcaggtaatttatatattacaacggatgatggttcttatggacgtcatggtatggttacaaaagttattgaagatttagtagctgaaggaaaaacctatacaaaatgtgtttccatcggaccgatgattatgatgaaattctgttgccttacaacacagaagcttggaattccgacaatcgtatccatgaacccgattatggtagatggtactggtatgtgtggagcatgtcgtgtaattgttggagatgaagtgaaattcgcatgtgtagacggaccggaatttgatggacatctgattgactggaatcttgctatgcagagacagcagatgtacaagacagaagaaggacgtgcattattaaaacagcgtgaaggagatactcatcacggtggatgcggaaactgtggaggtgacaaataatgggtgacgtattaaagaaagttccggttagagaacaggacgcaaaagtaagagcaacgaactttgaagaagtatgtttaggatataataaggaagaagcagtagaagaagcaaatcgctgtctgacttgtaaaaatgcaaaatgtgtacagggatgtcctgtaaatattgatattcctggctttgtaaaagaagtaaaagaaggaaattttgaagaagcttataaagtaatcggaaaatcaagttctcttccggcagtttgtggtcgtgtatgtccgcaggaaagccagtgtgaaggaaaatgtatccgtggaatcaaaggtgaagcagtttccatcggtaaattggaacgttttgttgctgactgggcaaaagaaaatggcatcaaaccagaagcagcagaagtaaaaaatggacataaaattgctgttatcggttccggtcctgctggtcttacctgtgctggtgacctggcaaaacttggctatgatgtaacaatctttgaagcacttcatcagccgggcggagttttagtttatggtattccggaattccgtcttccaaaagataaagttgtaaaagaagagattgaaaacgtaaaatctcttggcgtaaaaattgaaacaaacgttattatcggtaaatctactacaatcgatgagcttcttgaaaaagaaggatttgaagctgtatttatcggttctggagcaggtcttccgatgtttatgggaatcccgggtgaagtaagcaacggtgtattctctgctaatgaatatctgacaagaagtaacctgatgaaagcgtttcgtgatgaccatgatacaccgattaaaactggtaagaaagttgctgttatcggtggtggtaatgttgcaatggatgctgcaagaactgcacttcgtctgggtgcagaagtacatattgtatacagaagaagtgagtctgagcttcctgcaagagcagaagaagtacatcacgcaaaagaagaaggaatcatttttgacctgttaacaaatccggttgaaattgttgcagacgaaaacggctgggtaaaaggtatgaaatgtgttcgcatggagcttggtgaagcggatgcttctggaagaagacgtccggttgtaattccggattccgaatttgaaatggatgtagacacagttattatgtctctgggaacttctccaaatccattgatttcttctactacaattggtcttgacacaaataagagaaaatgtattattgcagatgaagaaacaggaaaaaccacaaaagaaggcgtatatgccggtggtgatgctgtaacaggtgcagctacagttatccttgctatgggtgcaggtaaagcagctgcgaaaggcattgatgaattcatcaaaggaaaagaaaactaatcaaaagatgctaaaaaacccttctgctgctttggcggcagtagggtctttttgactttattcaaaacagatggagcaaatatgaagattacgctgattacagttggaaagataaaagaaaaatatttaagagatgcaattggagagtacagtaaacgcttaagtaaatattgtaaattagaaattattgaagtggcagatgaaaaaacaccggaacgtgccagtgaagtggtagaagagtccattcgttcaaaagagggagaacggattttaaaatatataaaagaagatgcttatgtaataacacttgaaattggagggaaacagctggcttcagaggaactggctgataagatagaacagcttggaatacagggaaaaagtcaaattgtttttatcatcgggggttcgattgggcttggaaaagaggtattaaaaaaatctaattatgccttaagtttttctaaaatgacttttccccatcagttaatgcgtgttattttgctcgaacagatatatcggagttaccgtattatcaatcgagaaccctatcataaataattctgctggcattttacgcattttgaatcacgactgcaatgaaaattaagaaccaaatcatctacgcgggtgcaggtggactttttataaagcacagtatgggtgacatcacttgcatcggtaagacacttggtatgatagattttcgtatattcatttgaggtatctgcagtgtctgacatcgtgggcatctcctttcaaggtaagtgataaatttatacttttagtataacggaaaagaagcaaaaagaaaagaaagttgaggaaagaaaatggtaacacacgaacaaattgaagaatttatctgtcagtatccggtgtatcagtatgctttttttaaacctgaagagattgaattttcttatcgggtgagatggatttgtgaacaggaatgtgagcgttataattctacctgggcatgcccgccggcagtcggaagtgtagaagaatgtaaacacagatgtctcaagtataaagaatgttttttgttttctacgattgcagaagtatccgatgtaattaattttgaagaaacacttgcaaccagagcggaacacgaagaggtaacagctgcaattgaagcatttataaagtcacagggaagcgagtgtatggcattgtccacagaatcctgcgacatttgtgatacttgcgcatatccagacggtccgtgtcgctttccggagaaaatgcatccttgtgtggaaagtcatggaattattgtaagtgagctggctgaaaagtttgatatggaatttacgttaagtccgaatcagattttgtggtttgggattttatttcttgcataaaaaatccgcataagaaattggtttttgcatatttatattaataagaagtatgggataaacggttcatgcgaaaaaaaagcgtcccacagaaactggcagacaagatgcagattccaaaagacttggcttatcaggagccagtgttaacgatgattggacaaagggaactttgtgttgaaaattataagtgtatccgatattatacggatagctgtattgttttgttaacaaagaatggtaaattgaagttagagggagacagactttccattcaatcgtatgataatgaagaaattagaattaccggaataattttcagattagaatttattggctaaaaagagttagattgctaaatggggaggaccaggtgattttaggaaaaaatttctggaaaggatatctcaggatttgtttttggggacaagaatcggaacgatttttaaatttgtgtgcacatcataagattcaaatttgtcagattgaaaaacacgaggcggtttattggggttatgtattgatttcagatttttatcggatggatgaagtaagaagaaaaacaggaactaaaattaaaattaaaggaaaatacggaatacctttctttttttacagaaataaaaaaagaagggtattttttgttggatttttactggcactgatagctgtatttttattatcagaaagagtatggaatattcatgtggagggaaatgttcataattcaacagaatcgattttaaattatcttgaaacacaggatgtatggcatggaatgagaagagaccaggtagaatgtggctatattgcagggaagcttagaaaagaatttccggacattacatgggtatcagcgaaattgacaggaacgagactcatgttagaagtaaaagaaaatgaaagctatcaaaaagaaaaacagttacaaaaaaaagaaatgccctgtgatttacgtgcacaaaaagatggaattatcttatctatgattgtaagaaagggaaaggcaaaaaagaaaataggagagaattgtagtaagaatgaaattttagtgtcgggaaaaattccaattataaatgatagtcaggaagttatgggatatcaaacggtgcaggcagatgcagatatcgaaattcaatataaaatggaatattatcaggagttttcgagaacctatcaaaagataataccgagtggggaaacaaggcagggttatatcattcaggcaggaaattattatcttgataccagtcgaaacttaaaaaagcaggaatataatcggttgctgaaacttcgacagttgaagctgacagaaaattttaagctacccgtgttctatggaaaaagtatagattatgcaatagagaaaaaagagaggatttatacgaagaaagaggcagaaaaaaaggcagagcagacaattttacgtgtgctagaaactttatcacaaaaaggtattcaaatatctgaaaatcatgttagaatagaggtaaacaagaacagctgtgtgacaaaaggaagtttgattttaattgaaaaggcgacttgtcagacaccgctgaagacagaaaggaataacagcatagatgagcaatataattgaatctcggatggattttccggcagaacatgaaaaaaatgtgtttggacaattcgacgaatatgtaaaaaaaatagagcgggcattaaatgttacgattatttcaagagatggaaaattaaagattttaggaaatgaaacttctgcaaatcaagcacagagggtgatttcacagttgttaatgttttctaagaggggaaatacgattacagaacagaatgtagattatacgctttctcttacctttgaagaaaaagagggacagatggcagagatggacagagattttatctgccacactatcaatggtcgtccgatcaagccaaaaacactgggacaaaagtcttatgtagatgaaatccgtaagaaaatgatagtatttggtgtcggacctgccggaaccggaaaaacctatctggcaattgcaatggcagtaactgcatttaaaaatgatgaagttggaaaaattattttaactcgtccggcaattgaagcaggtgaaaaactgggatttttaccaggggatttgcaaagtaaaattgatccatatcttcgtccattgtatgacgcactgtatcagattatgggaccggaaagttttgcaaaaaatatggaaaaaggtctgattgaggtggcaccacttgcatatatgcgaggtcgaaccttagataatgcctttattattctcgatgaagcacaaaatacaacaccggcgcagatgaaaatgtttttaactcgtattggttttggttcaaaagtaattgtaaccggagataagactcagaaagatttaccggcaggggtacgctctggattggatatcgcaatgcaggtattgaaaaaggtagatggaatttcattttgccagttgactaataaagacgtggtacgtcatccgctggtacaaaagattgtagaagcttatgatgagtatgagaaaaaacagaaacctcaaaaagaaacaaaagagatgaaaagaaagagggagtggaaatgactttaaatattgataaagaatatttgggagaactgggatttgattatgaaaaaattgcaaaagaagtagtggaagcagcactggattttgaaaaatgcccttatgaagcggaagtcagtcttgtacttacgacggatgaagaaatacgaaaaacaaatgctgagtttcgtaaaattgaccgtgtgacagatgtcctttcttttccaatgcttgactttgatactcctggagatttttcctttttggaagaagaggaagatgcatttcatccggataccggagaattgattttaggagatattatgattgcagtcggaagaatgagagaacaggcagaaacttatggacatggggaagtaagagagtatgctttcttaattgcacacagtatgctgcatctaatgggatatgaccatatggagccaaatgaagcggctgttatggaaaagaaacaggaagaaatcttagaagaacttggaattctccgtaaataaaaagtttttgaatcaaagattgaataaataaaaaaataaagtcgatactagtttcataaaaacaatttacgctcggaatctggtggcatttgatttaaccaaatcaagtaagtcttcgagggtaatgaacaatagtaaggagtgtcttttatgaaaaaaataatttctggtatcggcttttttttgtctgctcttgtaataggaaatggtattgtttcttattgtgaagtatctggcttaaaagagaggatacaggatttggagacagaaagtgactggattggaaagcaggtatcagctgttccatttaaccagaataaaaaatatgtatttgaatcttatgatgagaagagtggaagtgtaaaacaacaagtataccggattcactcttatggagaaaaccagattgtgcttcaaaaagaagaaccggacaatcaggagatttttttgataaaggtaaaagatgattatcttgccgtatacaaaaaagcagacaggcagttgtttgaaacgaccaatattccaatagaggcactgccttcagacgaacaggtacaagtgctggcaggcaaggaagtaacaggaacagaagcactttacagttttttggagaattattcttcttaaatcctactttacgaaagaaaaaaaatgtagtaagataaaaaaacatgaaacaaagccagaaatccttagcttttaatatagaaaaagtataaaaaggcgatacaggagaggagaatacatgaaagtacgagaccgattaaaagagaaaaaaagaatcgtagtaaagataggctcttcatcattgacgcatgaagaaaccggtcgtttgaatttgatgaaaatggaaattcttgtaagagagcttgcagatttacataatcagggaaaagaagtgattgtggtttcttcaggagcgattgcagtaggaagaagtgcgatgggaattgaccataaaccgaaggaacttgcgaaaagacaggcatgtgcagcaatcggacaggcacgcctgatgatgatttatcaaaaattgtttgcagaatacaatcagacagcagcacagattttgatgacaaaatatacgatgattaaccgtgcaacaagaattaatgcaaaaaatactttcgatactctgcttgagatgggcacaattccgattgtaaacgaaaatgataccatttctacagatgaaattgaatttggcgataatgatacactttctgcactggttgcggcgctgacaggggcagatatgttaattttgctatccgatattgatggactttttacggatgacccaaatcagaatccaaatgcagaatttattgatctggtagaaaaactggattctcatctggatgctatggcaaaagatacctcaaagagttctgtaggaactggcggaatggcaacgaaattaaaggctgcacatatagcaactagtgcaggtgctgatatggtcattgcaaatggaaatgatttccatgtcatacataaaattatgcagggaagaaatcatggaactttatttttagcagataagaaagaagagttttatctggatgacattattgataaattgggatagaatgaaataaatgtactaacagaaaaatttggagagcacagatataaagaagcggaggaattttcatgaaacaggaacagattgagcgaattaacgagctggcaagaaaatcaaagacaacaggtctgacaccagaagaaaaagaagaacaaaaaaaattacgtgcagaatatattgcatctgtccgtatgaatttgagaacccagttagataacattaacattcaggaaaaagatggaagtattgtcaatttgggtgagaagtatggaaaaaagaaaaagacacattaaaaaataagctaagaaagaaatagaaagggtatccgctgtcgggatgctctttttgtttcttaatgaaaattatagaatgtgaaataaaaacactctgtattgaaaaataaaaaagattaggatataatagaaaaattgataacagataaattagaatggagaaatacatgttaaaaaataaagaactggaagaaattttagaaaagattgacttaaatgaagcaccgccggcagaagagccgatgcgtcagtattattttatgaagaaagcgcagatgcttgtaaaacaaaaaagcgaagaactgggacgtcctttaacctatcacgtaacgactttcgggtgtcagatgaatgcgcgcgactctgaaaaattagtgggtattttagatgaagtgggttatacagaagtagaagatgaaaatgcggattttgttatctataatacttgtacggtccgtgaaaatgcgaatcagagagtgtacggtcgtttggggtatcttcacagtatcaaaaagaagaagccgcacatgatgattgctctttgtggctgtatgatgcaggaagcacaggtagtagaaaaattaaagaagagttattcttttgttaatctgatttttggtacacataatatttacaagttttcagaattgattgtaacagcgttagaatcggaccgtatggtcattgatatctggaaagatactgataaaatagtagaggatttgccaagtgaacgtaagtatgcctttaaatccggtgtcaacattatgtttggttgtaataatttctgtagctattgtattgtaccttatgtaaggggaagagaaagaagccgaaatctaaaagatattgtccgtgaaattgaaaagttagtagaagatggagtaaaagaagtcatgcttcttggacaaaatgtcaattcctatggaaaaaatttagaagagccggttacctttgcacagttgttaaaagaaatcgaaaaaatcgaaggcttagagagaattcgttttatgacttctcacccgaaggatttatcggatgaattaattgaagtgatgaaagacagcaagaaaatctgccgtcacctgcatctaccacttcagtcagggagcagcagaatcttaaagattatgaatcgtcattatgataaagagcgttatcttaccttagtaaagaaaattaaaacggctatgccggatatttctctgacgacagatattattgttggatttccgggtgagacagaagaagatttcttagaaacaatggatgtggtaaaaaaagttcgttttgacagtgcatttactttcctttattctaaacgaaccggaacaccggctgctgtaatggaaaatcagatttcagaagatgtaatgaaagaccgttttgaccgtttgttagaagaagtacagacgattggaagggaaatgtcatccagagatacaggaagtgtacaggaagtactggtagaagaggtgaatgagcatgacccttctttagtaaccggaaggatgtctaataatttactggtacattttcctggagatgcttcattaattggaaatattgtttccgttcaccttgatgaatgtcgcggattttattatatgggaacaaaggtaggctaaaagaaatgggattgaagataaaagacgtagaggtatcatccttatcaccgatgatgcagcattatgtaaagacaaaaaacgaaaataaggattgtattttgttttatcgtctgggagacttttatgagatgttttttgaggatgcagaagctgtttcaaaagaattagagttgacgctgacgggaaaagactgtggattaaaggaaagagccccgatgtgcggagttccatttcatgcagcagatacttatatcaatcgtctggttgaaagagggtataaagttgctatctgtgaacaggtagaagatccgaaaacggcaaaaggcatggtaaaaagagaagttgtccgtgtcgtaacaccaggaacaaatttaaatacacaggctttggatgaaaccaagaacaactatattatggcgattgtctatctttccaatcgttacggaattgcaattgcagatgtgactaccggtgatttcatggtgacggaagtagaaaaatcaagaacacttttggatgaaatatataaattttcaccggctgaaattatctgtaatgagtccttttatatgagcggagtggatttggaggaattgaagaatcgtctgcacatctgcatgaatccactggagggctggtattttgatgatgaattatgcgtaagaactataaaagaacattttcatgtcagtgcattagaagggcttggattaaaagattttgcctgtgcaacgattgcagcaggtgcgcttttgacctatcttttagaaacccagaaaactccgcttgaccatctgcgtgcgattatgccttatgcaacggaacgttatatgattattgatagttcaaccagaagaaacctggagctgacagaagcactcagagaaaaagtaaaaaggggttctcttttgtgggtgttagacaaaacgaaaaccgcaatgggagccagaatgttacgttcctttattgaacagcctttaattgatgagcatgcgattaatgaccgtcttgatgcgattgaagagattaataagcgggaaatggaccgcgaagaaataagagaatacttaaacccgatttatgacttggaacgtctggtaggaaaaatcagttatcagtcggcaaatccaagagatttgattgcatttaagtcttcgatttccatgcttccttacataaaaggactgataaaagaatttaaaagcgaagagatgcagtctatttatgaaaatatggatgatttgcaggatttatttgaacttttaaatgcatcgattatagaagaaccaccgcttgccatgaaagagggtggcatcattaaagatggctatcatgaacaggtggacaattttagacaggcaaagacaaagggaaagacgtggctggcagaactggaagcttccgagcgtgaaaaaacaggaatccgtaccttaaaaatcaaatataacaaagtctttggatattatcttgaagtaaccaattcgtttaaagatatggtgccggattattatacgagaaaacagaccttgacaaatgccgagcgttatatcactccacggttaaaagaactggaagatatgattttaggagcagaagataagctgtatgcgttggaatatgaaattttttccggtatcagaaataaaattttccaggaagtggaacgagtacagagaaccgcaaaagcgattgcaagattagacagttatctttctttggcacttgtggcatcgagaaataattatgttcgtccaaaaatcaatacaagaggaatcattgatattaaaaatggacgtcatccggttgtcgaacagatgattccgaatgatatgtttattccaaatgatacttacctggataatgcaaaaaaccgtgtctcagttatcacaggaccaaatatggcaggaaaatcaacctatatgcgtcaaacggcattaattgtactgatggctcagattggttcttttgtgccggcagaaaaagcaaatatcggtattgcagaccgtatttttacaagagtaggagcgtcagatgatttggcaagcggacaaagtacctttatggtggaaatgacggaagttgccaatattttgcgaaatgcaacttcaaagagtcttttgattttagatgaaatcggaaggggaacaagcacttttgatgggctttcgattgcctgggcagttattgaatatatcagtaacacaaaagtattaggagcaaaaacgctgtttgcgacgcattatcatgaactgactgagttagaaggaaaactttccggagtaaataattactgcattgcggtaaaagagcggggagatgatatcgtatttttgcgtaaaatcgtaaaaggcggtgcagataaaagttatggaatccaggtggcaaaactggcaggagtgccggatgtggtcatcgaacgagcaaaagaactggtagaagaactttccgatgcagacatcacagcaacagtaaaagatattgctttggagcgcaaaaaaggaaaaacgaaagcaaaatctcaggtgcatttagatgaggtggatttagaacagatttctctatttgatacggtaaaagatggtgacgtgttagaggaactaaaaaatattgatgtctcaaatctgacaccaattgatgcgttaaatacaatctataagcttcagaataaacttaaaaatcggtggtgaatcaattgagaaaaattgcagtattagaccagagtacaattgataaaattgcagcaggagaagtcgtagaacgtccggcctccgtggtaaaagagttagtggaaaatgcaattgatgcaggctctactgcaattactgtagaaattaaagagggcggaatttcatttattcgagtaacggacaatggaagcggaatggaaaaatcacaggtcaaacttgcgtttttaaggcatgcgaccagcaaaattgaaaaagtggaagatttgctggaaatagaatcgcttggatttcgaggagaagctctttcgagtatttcagcggtggcacaggttgaaatgattacaaaaacagcgcagtctttaactgggattcgttatctgatagaaggcggaatggaaaaggggttagaagaaatcggagctccttgtggtacgacaattctggtacggaatctgttttttaatacacctgcccgagcaaaatttttgaaaactccagttacggaagccggctatgtcagcacctatatggaacagcttgccctgtctcatgcacatatttcatttaaatatatggtaaatggacagacaaagcttcatacttcgggaaatgcgaatttaagagatgtgatttacagcatttatggacgtgagattacaagagaattgattccaatccagtgggaacaaaatggaattaaattagatggatttgcaggaaaaccagtgattgcaagaggaaaccgcgcctttgaaaattattatattaacggacggtatgtaaagagcaaaattattatgaaggcaattgaagatgcctataagccctatatgatgcagcacaaatatccgtttgtgtgtctgaagtttgaagttccgggagatgaagtggacatcaatgtgcatccaacgaaaatggaagtacgatttcaaaaacaaaaggagatttatgagtcggtttatgaagctctgctttttgcaattggaggaaaagagctgatcccggaagtaaaatttgaagaaaaagaatcagaattaaaaaaagtggagtctgataagaaagtccacaaaaaagaaaatggtccagagccatttgaagtaaaacgaaaagagagctttttggaagcactttcttttggacaaaaaagagaaccacaaaatcaaattcgggaagacagaccagaatggaaagcaaaaaaagaaccacagtcaaataatgtgagtgttcaaccggataaagtcaaagatacagaagttggagtttctcaggtaattgaaaaaaaagagaatcaaagaaaagaaactattttggagacagtttcagaagagggtttagaaaaacaggcagaagctgtaaaactggaaacaaaaacacaagaaatcagacaacccaaattggagcagcgggaagaaacaaaacagatggagctgtttgatgacaggttgttatcaaagaggtcaaggaaacatcatcgtattatcgggcagttatttgaaacttactggttagtagagtatgacgaaaaattttatattatcgaccagcatgctgcacatgaaaaggtattgtatgaacgatttatgaaagaatatgaaagtaaaaatattctttctcagattatcagtcctccacagattatcagtttaagccttcaggaagcagaacttctaaaggtaaatcagaagctgtttgaagaatttggttttgaaatttcttcatttggaggaaaagagtacagtatcagtgcagtgccgtcgaatttatatggagtcgatgtagaagaactctttcttgaaattttaggcagtcttgatttagaaggcagtcataaaacaccggatttaatccgatatcggatcgcaacttctgcctgtaaagcggcggtaaaaggaaatcagacactttctgttttagaagcagataaactcattgatgaattgcttgggcttgaaaatccttatcattgtccacatggaagaccaacgatagtttcaatgacgaaatatgagttagaaaagaaatttaaaaggattgtgtaggtgaaaaaagtgcagaaacctctgattatattaacaggtcctacagcagtagggaaaacaaaactctcgatttctctggcaaaagcggtaaatggagagattatttccgcagattccatgcaggtataccgccacatggatattggttcggcaaagattaggtcggaagaaatgcagggagtgaagcattatctgattgacgaattagaaccggaaaattcttttcacgtggtagaatttcagaaaatggcaaaaaaagcaatggaagaaatttatgcaaaagggaaaattccgattttagcaggaggaaccggattttatattcaggcaattgtaaaagatattgatttttcagaaaatacagaagcaggaagttatcggaaagaattagaagcgatggcaaaagaaaaaggagtacattacctgcatgaaatgcttgaaaagatagatgaagtttcagcacaggcaattcatgaaaataatgtgaaacgtgtgattcgtgcattggaatactatcatttgacaggagaaaaaatttctgttcataatgaaagagaaaccaaaaaagaatcgccttattgctttgcctactttgtattgaatgatgaacgggaaaaactgtatcagagaattgaacagcggattgatgagatgcttgaaaatggtttaatcgaagaagtaaaagcattaaagagaagaggctgtacaaaagatatggtttctatgcagggactgggatataaagagattttgtcgtatttagatggagagtattcgctggaagaggctgtttatattttaaaacgtgataccagacattttgcaaaacgacaaattacctggtttaagagagaacacgatgtaatctggctggaaaagccggaatttgactatgatgaaacaaaaatattaaattatatgcttaagatatgtaaggagaaaggaatactataatgcaggaacttagttcaatgtacagtgaacttggaatttcaaaagaagtgctggagtacggaaaaaaaatagaagaaaaattaaaagaacgatttgaaaaaattgatgagacagcagagtataaccagttaaaggtgattcatgctatgcagaaacataaagtaagcgaagcatgtttgtattcttccagtggttatggatataatgatttgggaagagatactttagaagaggtttatgcagaagcgtttcatgcagaagcagctctggtgcgccctcagattgcatgtggaacgcatgcgcttgcagttgccttatctggaaatttgcgccctggagatgaactgctttctccggttggaaaaccgtatgatacattagaagaagtaattggaatccgtccatcaaaaggttcactggcagaatacggagtcacttaccgtcaggtagaattattagaagatggaacatttgattatgaagcaattaaaaatgcaatcaatgaaagaacaaaactagtagagattcagcgttccaaaggatatttaactcgtcctacgttttctgtaaaacagattggagagttgattcattttattaaagaaattaagccagatgtaatctgtatggtagacaactgttatggcgaatttgtagaacggatagagccgagtgatgttggtgcagatatggtagttggttctctgattaaaaatccaggaggcggattggcgccaattggtggttacattgtaggaacaaaagaatgtgtggaaaatgcagcctatcgtctgacctctccgggacttggaaaagaagtgggagcaactttaggtgtaaacccagcgttttatcagggatttttccttgctccgactgttgtagcaggtgcattaaagggagctatttttgcggcaaatatttatgagacattaggatttgatgtcagtccgagtggaagcgaaagtcgtcatgatattattcaggctgtaaccttccatgtgccggaaggagtcattgagttttgtaaaggaatccaggcggcagcaccggttgacagctttgtagagccggaaccgtgggcgatgccgggatatgacagtgaagtcattatggcagcgggagctttcgtccagggttcttcaattgaactttcagcagatggaccgattaaaccaccgtataccgtatattttcaaggaggtcttacttgggcgcacgcaaaatttggaattttaatgtcacttcagaagttagtagagaaagagattgcagtgcttccaaaataggagaacaaacaaaatgaaacagataagagtatgcgtaattgggggaggcgcttccggtctgattgcatctatttttgctgcaaaagaaggcgcagcagttactcttttggaaaaaaacgaaaaacccgcaaaaaaacttttgatgaccggaaatggtcggtgtaattttacaaatgaatatcagaaattggaatgttatcacagttatcacgaaaaagagtcacaatttattcgtgaagtgtttgagcaattttcgatggaagaaacggtaaagttttttaaaaggattggaatttatccgaaaagccgaaatggctatctttatccagccagtaatcaggcatcaagtgtggcagaagtcttagaagcagaggcacgttttcgaaaggtaaaaataaaattgaacgaacaggtgcttgcaattgaaaaaaacgaacaaagtgatacgtggctggtaaaaacaaaaggctggcagtatgaagcagagcgaattattattacttgtggttctcctgcttctcttttagaagaggatggctgggatggatatacgtttgcaaaaagcttagggcatcagattgtgccggtacttcccgcacttgttccattaacctgtaaggtcggatttttaaagcaatgggctggtgtgagagtagaaggtcaggtttcttttatacagaaagaggaatgccttgcccgtgaaagaggagaattgcagctcacagaatatgggatttcgggaattccggtttttcaaatcagtgcgtgtgtagcaagaaatttatcagagaatggtcagggaagcgttgtgctggattttatgccagattttacgatagaagaagtagaagcattattaagggaacgtcaggaaaactgtagctacaaaaacttaaaagaattgttgatcggtttatttcctgcaaaactgattccgatactggtgaccaaaaagataacagaaaaagaactggcattccgaataaaaaatttggaacttccgttaaagggaacaaaatccattcgtcaggcacaggtatgtcagggcggagtcagtgtttctgagataaatgaaaaaacaatggagtcaaagcgttgtcctggtatttattttgcaggtgaggtcattgacgtggatggaatctgtgggggatataatctgcaatgggcctggtcaagtggtgcgatagccggaatgtatgccggaaaggagaatacatgattacactacagcaagtaaaacttccaatttctcatacaaaagaagaattggaaaaaaagattttaaagacattgcgaatcaaaaaagaagaactgcttgggtatgaaatcagaaaacagtctttggatgcaagaaagaaaccagaattgttctttgtctataccattgatgcaagtgtaaaaaaagaagagatcgtaataaaaaaaataaaagaaaaaaccgtatcaattataaatcggaaaaaatttgaatatccagctgtaatagaatggtcaaaagcttcacgtccggttatcacagggagtggtccggcaggattgttctgtgcgtattatcttgcaaaagcaggacttgctccgcttgtgattgagcgtggtgacccggttgagacaagaatggaaaaagtagagacattctggaaagaagggtttcttgatacagagtcgaatgtacagtttggagaaggcggtgccggtacattttcagatggaaagttaaatacgttagtgaaagatgcgatgggaagaaatcacgaagttcttcgtctatttgtagaatgtggagcacccaaagaaattttatatgtacaaaaaccgcatcttggaacagatttattggttacgattgtaaaaaatcttcgccataagatagaagaattgggaggagaaattcgtttccgcacaaagttgacacaaatttggcaggaaaatggcaaattaaagtccattattgtaaatggagatgaagaaattgcgacagattttctggtgcttgcaattgggcacagcgccagagatacatttgaaatgttagagcgagaaaaatttctcatgcaggcaaaatcatttgcagtggggcttcggatagaacatccacagtccatgattgatgaatatcagtatggtacaaagaaacatgcaggaaaacttggagctgccagttataaactgacccatcgagcagaagagggacgaggcgtttatagtttttgtatgtgcccgggaggatatgtggtcaatgcttcctcagaagagggcaggctggcagtcaatggaatgagctatcaggatagaagtgcgaaaaatgcgaatagcgcaatgatcgtcagtgtaaatccgaatgatttttgttctcaggatgcacttgccggtgttgcttttcaaaggcagttagaagaaaaagcctatcagttaggaaagggaaaagtgccagttcagctctttggtgattttatgaaccatagaaaaagcagtggatttggcatgattgatacttgtatgaagggagcttatgaatttgcagacctaaatgaattacttccagaatttttaagccgtccaatgaaggaaagcatttcttattttgggcggattatcgctgggttttcaagggaagatgccgtgttatcaggaattgaaagtcgaacatcctctcccgtaaggattgtgagaaaagaagactttcagagcaatgttgagggagtctatccttgtggagagggtgcaggatatgctggtggcattacatcggcagcaatggatggcttgaaagtagcagaggcaattgtgaaaaatacaataaatttttgagattccatatacatcgtttttaatctgtgataaaataaagtttgctgaattgataccctgtatttggctgaagagagtatatggtatcttatgtacaatgcaagaaaaatgaaagaaattcccgaagaaaaccgaccttatgaaaaatgtcttaagtttggggtcgaagcgctgacggatgaggaacttctggcaattttactgcgcagtggttcgaaagaacattctgcattagaacttgcatatcaagtcctgcatttatcaaaagaaaatcagggactgcaaagtatttatcatttaagtgtacagcagttgaaaagcattcatggaattggcgcagtaaaagccattcaattaaagtgtatgggagaaatttccaagaggattgcagtaaatgttgcagcgaagggaatctcatttgactgtccggcttctattgcgaaatactatatggaacaactgcgtcatgaagaacaagaacatttgctgtgtatgatgctggactgcaagaaccatcgtcttggagaagagcttatttttaagggaacagtaaatgcatcttatgtcagtccgagagagattttcttaagtgcgatgtcgtaccatgcagtcgggattctgctggtacataaccatccaagtggagacccgtctccaagtcaggcagatatccaagtgacgaagaagatacagacagctggaatcctgcttgatatacctctgatagaccatattatcataggggattgtcagtatatcagtttccgggaaaggggacttatcgaaacataaaaaaggggagcagaatatgccactttacaaaacatttggtgtagatttaggaaccagtatgattaaaatctattctgcacagaatgattcaattctaaaagaaaagaatatgattgcaattcgcaatgaaaatcaaattctggcttccggtaatgaagcatacaaaatctacgaaaaaaacccatcgaatgtatccgttattgagcctatggcatttggaaaaattgcagatatcaaccgtacagaaattgtactgcagtccctgcttaaaagagcaggttctcagcaattttttgggaattcggtatatcttgcagttccgacagatttgtctgagattgaaaaaagggcttattatacaatcggaaattccaagagaaaaaataaagtttatatggttgaaaaaccgattgccgatgcagtatcacttggacttccaattaatcatacaagcggaagtatgattgtaaatatcggtgcacaaagtactgaaatttcaattattgaaaagggaagagttgtcatcagtaaaatggttgaagttggaggaaaacagcttaatgaagccattatcagtatggtaagaagaaattgtaacctgaatataggagaacgttcggcagccagactgaaactgtcgctttcctatttgaaagatgacccgcaggaggtaagaaaagtagtgggtgttgattggattaccggtctgccacaggtgggggtggttacttcggatatggtgaatgaagcgattgaagaaccgtttttgaaaatctgtgaagaaatccgattctttttagaccgcattcctccacaaatctattcaaacatagcagatgaaggtgtatttttaattggaggaacaacaaaaattccaggagttggctggtttatcagtcaggaggtaagaatacgggttcgtctttctaagtatcatgatttatgtacgatatacggaattaaagaaattataggaaacaaaacactctggaaatgggtaaaataggaactgaggttgtacaatgaaaaaaaaacgcaattggaatttgaaaagtaaacacattctcataattatggtcgttgtctgtgttggattaatgctgcttacatttgctgcgaaatttccagtacagtcagtccggacaacagcaggttatacaattgtaccttttcaaaatggattgaataaggtagggaatgctttggatggatttacggaaggattccgaagcaagaaaaaactgattgaagaaaataaagcattacaaagtaaagtagatgaccttactgcggaaaacagcaggctgacacaaaatgtaagtgaacttgccagactgcaggagttgtatcaattagatcagcagtataatgaatatgataaaatcgcagcagaagtcattgcaaaaaattccggaaactggtattctacgtttaccattaatcgtggaagtgaagacggaattttagtagaccagaatgtaatagccggaagtggtttggtaggaatcgtaacagaagtcggagcacattgggctaccgtccgttcgattattgatgattcaagtaatgtaagtgcaatgacagtaagtacatctgcaaactgtgtggtgtgtggtgatttaagactgatggatgagggaaaactgcagtttattcatttaaaggatgatgaagataaggttcaggaaggagaaaaaatcgtgacttctgcagtcagcgataaattcttaaaaggaatcttaattggctatgttagtgaaattgaagaagatccaaataatttaacaaaaaccggaacattaacaccggcggtagactttgagcatttacaggaagtactggtgattaaagagttaaaacagcagaaggaggaagataaatgagaatacgcagaaaaatagtactgtttcttctgcttctggtttgttttattgttcagggaacattcttgaaagtaattgcaattggctcgatttctccaaatttgattctgatttttgtagtttcttttggatttatgagaggaaaaagaacaggaatctggacaggatttgtatgtggcttatgttgtgatttgctgggagatggaatcctgggatattatgcactgatttatttattaatcgggtttggagcaggatgctgttgtaaactgttctatgatgatgaacttcgagtaccggtgcttattgttgccgtgtgcgacctggtttatggaggaatggtatatgtgttgggatttctgcttcatggacgaatccagttcttttactatttctctcgaatgatgataccggaaatgatttatacagtactgttaactgcaattttgtataaagtctttttaaagataaataagaagctgacagagctggagatgaaggagcgagattccatttggttaagaaaataaaaaaaatacttaataaattatgcataaaaagaacaacggtattatttattgtttttgcagtcatgttttttattttactgcagcgtctgttcgttcttcagattatcaagggcgaagaatatgcgacaaattttaatctgacaacaacaaagacaagaacaattaagagtacaagaggaaatatccgtgaccgaaacggtgaactgcttgcacataatcagctggcctattccgttattatcgaggataatggaacgtatgattctactcgagaaaaaaatcttacactgaatcatgtggcttatgagattttaaaaattttggaagaaaatggagaatctgtggatgttaccttccatattacactagatgaaaatggagagtatgcatttgataccactgactttaccttagatcgttttaaggcggatgtttatggacaggctaaaattgatgacttatctaaagaggaagcaaaagcatccgcagccaggatgatagaagatttgtctcaggcagaccgttatggacttgtaaataaaaagaaaccatatacggaagaagaacgaaaagagtatggactgccggaaagttttacaaaagaagaagctttggatatcatcaaaattcgttatgcacttgcagcaaacagtttccagaaatacatgccggcgacaattgctacaaatgtaagcgaaacaacaatggcagcaattatggaggaaaaggatcagctccagggagtggatattcaggaagactccattcgggtttatgaggatagtgagacatttgcgccggtcattggttataccggaaaggcttcatccgaagaactggatgaacttaaaaaagaaaattcgaattattcttcggatgcagtaattggtaagactggtatggaacagtatatggaattacagctgcagggaacggatggagaagaaaagttaagtgtagataatcttggaaaagtattgaagattgatgaatcttctaaaaaagaccctatatcgggaaacgacgtttatcttacaattgataagaatcttcaaaaagcagcttatcagattctggaacagaaaattgccggtattctggcaagcaatattatagctggaaagacatttgataaaacggggctggattcaagtgaaatccggattccgatttatgacgtctataatgcgttgattgaaaacagtgtgattgatatcagccattttaaggaagaggatgcttctgaaacggagaaagcgatttacagtgtcttttcacaaaaacagagtgaagtgtttgactctgtaaaagcagagcttactgtctcaaatccggaggcatttgataaactgccacaggagatgcaggattatcagagttatattgtaaatgattttctgattaataaaaagggaatcctgtcgttagatgcaatcgatgcttctgatgcaacttatattgcatggagtaaagaccattctattagtttaaaggaatttcttacttatgcggccagtcagaactggattgatatttcacaattctatgcagaagaagaatatctggattcttctgaggtttacgatgcgctgtccgattatctgacagaatctttgacgacagacagtggattctcaaaaattatttacaaatatatgttacaaagtgatttgatttccggcacacagctttgtctggtcttgtacgatcagggagtattagaagcagatgaggcaacctattcggcgctccaggcaggacaaaaaagttcttatgattttatgttagataaaattaacagtctggagattacaccggcacagcttgccttagacccatgctccggttctatggtagtgacaaacgtaaaaaccggagagatactagcctgcgttacttatccgggttatgataacaatcgtctggcaaaccagatggatacggattattattcgaaattgtcttctgatttatcaagaccgttttataataaagcaacgcagcagaaaacagcacctggttctacctttaaacttgtaacggctcttgccggaatggaagaaggtattgccacaagtgattattatgtcaattgtacgggggcttttacaagaatttcaccggcaatcaactgttggtatcatgcaggacatggaacccttggagttcagggggcaattaaaaattcctgtaatgtattttttaatcagcttacttatgatatgggaaaagacaaaaatggagaattttcggattcaattggtcttagcaagctgcaaaaatatgcaaaaatgttccagttagataaggaatccggaattgaacttccagaagcagagccggaggtaacagatgaagcagcaatcgcttcttccatcggccagggaactaataactatacaacttctcaacttgcccgttatgcaaccacaatcgcaagtcgtggaacaagctattctatctcactgcttgataaagtgacagattctcaaggaaatttggttaaagattatacaccggaaattattaatcagatggatgtttctgattctgagtgggatatcattcataatggaatgagagaagtagtagaaaataatgcggcgtttgatgacctggattatgcagtatccggaaagacaggtactgccgaaaatacaggacatccaagtcatggtttatttattggatttactccatcggatgaccctgaaattgcaatggcagtgcgtattgcaaatggatatagttcaacaaatgcggcagcagttgcaaaagatgtcatcaagtacgaatataatcttgcagatgaatcacagttgttaagcggaaccgctacttctggagaaagcacagcgcagacagactaaacaattctattgggaggatggaacatgtgtgaaattattgtaattacttccggaaaaggcggtgtgggaaaaacaaccgtgactgcaaatattggacttgggttggcgaacttaaataaaaaagtggttgttgtagatacagatattgggttaagaaatctggatgttgtattaggtctggaaaacagaattgtttataacctgattgatgtcattgaaggcagttgtcgaatgaagcaggcattaataagagataagcattgtgaaaacttatacctgcttccatcagcccagacaagagataaaacttctgtcaaaccggaacagatggtaaagctgacaaaagatttggcggaagagtttgactatattttactggactgtccggcaggaatcgagcaagggtttaaaaatgcaattgcaggtgcaaatcgggcggtggtcgttaccactcccgaagtatctgcaattcgtgatgcagatcgaattattggtctgcttcaagcaaatcagatgccaaagatagaattaatcatcaaccggcttcgtatggatatgattcaaaaaggagaaatgatgtcggtagaagatgtgtcagaaatattggccgtagatttattaggtgcagttccggatgatgaggctgttgtgattgcaacgaatcagggagaacctctttgtggaaaacagtctttggcaggacaggccttttggaatatctgtcggagaatttgcggagaagccgttcccctgcttgattttgaagtgaaaaaagggttatggaagagattctcagaactgtttagaagatagtcaattttataaagggggcgccggcattgattcattttaggaagaaacgctcaggtcatatagcaaaagaccggcttaagcttcttttggtttcagaaaggcttagttgttctccacagatgatgaccatgcttcagaatgatgttgtatcagctgttgaacggtattttaccatttcagaggaacaagttgaaatacggtatataaaagaggatatgacatttctgataaagatacctttaaaaattgatatacaagagtcctatccaggattctgaaacagtcgccttgtgtgagactgtaagtaaaaaatgaattgagaaactgataaaaagacagaaaaaagaacaaggtgtttttatgataaaacaatatagattacgagattataattttagactggttattttcctgattggacttacttttactggagtgcttttagttggcagtgcagagccggcacttagaaataagcagttttttggaatgatgcttggagttgccatcatgctgattgtttctctgatggattttagctggattcttaacttttactggatattatacggatgtaatattatattgctgttgtctgtctggatttttggtacggaatcaaatggtgcttcaagatggcttagaattggaggatttcagtttcagccgacggagctttcaaaaatattgattgtcatgttttttgcacggttttttatggaacatgaagagaatttaaatacactgcggactttagttcagacagctattctggctgctattccgttaatgttgattttcagccagccggacttgaaaaatacaatcacagttgttatactgatttgtatcatgttatatcttgcaggcctcagctataaaattataggtggtgcaattttaattatcgtaccgcttgtggttgtatttttgtttattgttgttcagccaaatcaaaaattaattaaggactatcaaagagaccgaattatgacatttcttcattcagaggaagaagaatattcagatgatgttattcaacagaataattcagtgatggcaatcggttctggtcagttgacaggaaaagggttaaataacaatgaggttgcatctgcaaataaaggaaactttgtttcagaaagccagacagattttatcttttctgttgcaggagaagagttaggctttattggaagcgcagcgatattaattgttttattcctgattatctgtgaatgtattcggacaggatggaaagcgaaagatttgtcaggaaagttaatttgttgtggagtcgcttcgattattgcagttcagggattcattaatatttgtgtggcgactggaattgcaccaaatacgggaactccgcttccttttgtgagctatggactttcttctatggtatcactttatacaggaatgggactggttttaaatgttggtctgcagaaaaacagagattacagggaggttggtaaattatgaatattggacttatcgcacacaattccaaaaagaaactgatgcagaatttatgcatcgcgtatagagggattctttcaaaaaatacactttatgcaacagggacgacaggccgcttaattgaagaggtaacaaatttaaatattcataaatttcttgccggtcatcttggtggagaacagcagatgggggcattaattgaacagaatcagatggatttagtgatttatcttcgagagccattagcaccgcagaagcatgaccctgatgtaaaacgtatttttcatctgtgtgatacacataatatcccgctggctacaaatcttgctacggcggagatggtgataaaatccctggatagaggagagttagactggcgtgaaatgtacaaataaaagtgaaagacgaagacagagaaacaaaaatctgcttatggggatgggcgttgttattgttgtacttctgattgttctggcagttgttttaatcaagaagaaagatgcctctatgccggtttcttttgacttgacaacagaagtatttgggcagacagtagaggaagaagctctgacagcagacggattggcagcggatttatgtgtaggagctggagatacggcactcgatggtgtggaaacgcagggagatgagagagctgctttatttgatatccagaataaaacactgctgttttctaaatctttatatgaaaaatcctatccggcaagtatcacaaaaattatgacggcacttgtggcaatggaacatgcagatatggatgaagtcgtgacgattacagcgtcggatgttgctcttagtgctgattcacaggtgtgtggacttgcagaaggcgaccagattcagatgagtgagctgtttcatgcgttgttagtgtattcggcaaatgatgcagcaatggcaattgcaaggacggttggagatggaagtgtagatacttttgtacagatgatgaatgagactgcgcagagccttggaatgacaggaactcattttgtaaatccacatggacttcatgacgatgaccattatacaaccgtttatgatatctatctgatgttaaatgaagcaatgaaacatcaggaatttacagatattacacaattatcaaattatacgattacgtatacttcagcagatggaacacagcgccagaaatggcttgatgccacagatcaatatctgacaggagagtcaagtgctccaaaaggggttactattttaggcggaaaaacaggaacaacagataaagcaggcgcatgtctggcattaatggttcagaataattatggtgaaccttatgtctcaattgtgttagatgcgtcaaataaaccggaactttatgaaagaatgaatcaattactggagaaagtaaaccactcttaacgaaaaatgcgaaaaaattcacagaaaaatgaaattaaccattgtattcttgaacgaaatgcactataattgatttcaagataaccacgtttttagtaaaaatacatattacgtgcggctaaggaggaaaatgcgatggttcagttaattgtaggtgaaaaaggtaaaggaaaaacaaaagtacttctggacaaggcgaataatggtgtcaaagaagcaaagggctcagttgtatatctggacaagagcacaaaacacatgtacgagttaaataacaaagttcgtctaattaatgtgacagaatatgaagtggaaaatgccagtgaatttgtaggatttatcagaggaattctttctcaggataatgacttagagcaggtttatctggacagctttttaaaaatcgcaaaattagaggctgaagatgccccgcttacagaagtacttcaggaattagaaaagcttagtgaaagatttggattatcttttatcatcagcgtttccagaaatgaagaagaccttccggaagcagtaaagggaatgattgaaacttcactgtaaaaaaacaaagtaaaaacagtcactgtacatcaagagagaattgagtgtacagtggctgtttttttatttcatagtaagtttgctctatgaaatagaaagtgagtaaaaatttgtttttacgagctggcacttatatctcgaattcgaccaaacaggctgaaaagataaagtccgcagatgcctacaagaacatagacaattcttgaaagccaggataaattaccaaaaagaaatgcaaccaaatcaaaacgaaacaggccaatcagcccccagttgacagctccgataatggtaatgaccaatgctgtgtaatctaaaccatttgacttcatatgtttgcctcctttgtttctattttctgcctttttgataagttttatgcaaaaaaattaggtgttgccctaaaatgctgaaaatgataaaatgaaaaacggtacgaaaggagacgaaagattgtttattataaaaaagctatggaataaaataaaaaaattgccaagaaaggcaggaaggctgttgggaattcttggagaaatactctggatattatttcaaaaggcaggaagaatcttgaaaaaaggtcttcaaaagatacctcgtaatccgattgtagttgtaatcggtgttattatcatttatctgatagtgacagcaggtctgtatttttcttctgaacagattgaatcgtatcaagtgacatcaggaacgcttgaaaaaaacccagtttatacagcactggcaattcgagaagaaaaagtagtgaatgcaagtcaggatggatatttaagatatctgagaaaagaaggttcaaatgttgagaaaaatggaaacgtttatgcagttggggacagcgagattcaaattgcgaaatatgcgttagatgaaacacaaaaaagtaaaataaagaatgcggcagaagctttctctggaacgtttgattcctctgattttgctgatacatacagcttgaagtatgaattaaatggaatgatacttcagacagataaagcagaacagacggaggatacttcggacgaagaagagtatgatgaaaatggatttttagtggtaaaaggaaatacttcgattatgttaggaaatcaaaccgtggttacttcaccggatgctggaattgtaatgtatacgatggatggatatgaaggaaaaacggtggataatcttaaaaaaagcgatttcgcgcagaaatcttatacagaaaaaagtttgatttcaacagaagcaaaagaagatacacccgtttataaattgattacagatgaaacgtggaatctgatgatcccagtttccaaaaaagaagcgtcaaaactttcagaaggaacgattcaggtaaaatttttaaaagataaaaaaacgcagaacggacagctttctattgtggatatagacggacagaaagtggcaaaaattactttgaaaaatggaatggttcgttatgcatcggagcgttttctgaaagtggaactggtaattcatacaaaaactggcttaaaaattcctcttagttccattgtagacaagaaattttatatcattccgtccgactatcttgcgaaagaagttcaggatggtgtagaaagagagggattttatagaattacgaaagatgacaaaggaaaagaaaaaaagacttttgtggttccggctatttataaaaatacggcagattcatcggataaaagtacaagtacggtaattaaaaagatagattactgttatgttgatatgcaaacctttcaagaaggtgatattgtacagaagccagattcttccgagacatttacagtgggagaaccggaatatctttctggcgcatactgcattaatcgtggctatgcaatgttccgttgtattgagcagatatcaggagaacaaaatgaagaatcttgtctgattaagaaaaatacagcttatggtctttcggaatatgacagaattgtaaaaaatggttcttctgtaaaagaagatgaaatactaacaggaaaacaaggagagtaaagaatgagtgtttatgaaaattacttagaagtagaaaaaaaagtacaggaagcatgtaaaagagcaggaagaaacagagaagaagtaaccttaattgcggttagtaagacaaaaccagtttctatgattgaagaacttcttcctcatggagtagtggactttggagaaaataaagtacaggaactgactgcaaaatacgaagtgcttccgaaagatttaaactggcatctcatcggtcatcttcagagaaataaggtaaaatatattattgataaagcttgcctgattcattctgtagattctattcgtctggccgaaacaatcagtcaggaagctgtgaaaaagaatgtgacagcatccattttagtagaagtcaatgttgcagaagaagaaagtaaatttggagttacttctgaggagacagaaaaattggtagaggaaatttcaaaactgccaaatatcgaagtcaaggggcttatgacaattgcaccatttgtagaaaattcagaagaaaatcgattagtttttagaaatttaagaaatttaagtgttgacatagccgctaaaaaatttaataatgttactatgaatgtcttaagcatgggcatgactggcgattatgaggtcgctatcgaagaaggtgcaacaatggtaagagttggtaccggaatcttcggagaaagagattacagcaaatagagattggagattttaacatgagtgtttttaataagcttttagatgcagtaaaaatgagtgatgattttgaacaagatggatttttagatgatgattttgatgaagatgaggatgaaatcaaagaagaaaaaccgagaaagcgttttttaaagaaattagaagaagaggatgaggcagaagaattagaagaagaaccggtagtggaaagacgaacacagaaaaagaaagcagaaaagaaacagccggagaagaaaacaacggagaaaccctctttctattcaagaaataccaaaaatacaaagacaaccgaaagctcttctaaagtaacaccaatgcgcactgcaaagagaaatccagctccggctgcaatggaggtctgcgtgattaaaccaaataatatggaagaaaccagagaaattgcagatactttaattgcaggatgtaccgttgtccttaatctggaaggaattgatgtcagtgtggcacaaagagtaattgatttttcatcaggaacctgctatgcaatgggaggaagtcttcagaaagtatccgactacatatttattctgactccatcaagtgtaggaattacaggtgattatcaggagattatagatggtgcgttcatgtcctctatccagacagaatattaattcggaaagagcataaaaatggagaaagaacagttatttgaaaaacgtatgatagagttaagtaagaatgcctattacagaggtattcttactttctctgattttttagatttaaatgaattacataagttgcatagtcttcctcttaaacagtatggtgtaaaagtggaaacttttggaggacatgcgtttgcagagcgtcagatggcagcatttatccctgatgcttttttctttagtcaggaatatccgatttcctgtatttgtattcgtccgtctatggaaaaatttgcagaaaatctgactcatcgggattatttgggagcaattttaaatcttggaattgagagaagtaaaatcggagatattttggtagaagataaaaaagcatacatcttttgccataattcgctgtgtgagtttttgatgaatgaaatctgccgtgtccggcataccacagtcgttccatctatcattgagaataaagaagagtttccgagtgtaaaacttcaaaaagtcacaggaacggtatcttctgtgagacttgacagcgttacggcgttggcattttcgacttcgagaagcagtattttaccattaatcgaagggaaaaagttatttgtaaatgggaaaaatattgtttcaaatgcctatcatttaaaagaaggagatattgtatccgtcagaggaaaaggaaaatatcgttttgatggaacaacaaatttaacgaagaaaaaccggtatcatgtagaagtttcgcgttattgctaaagtcaaaagagacagaaaggaacgaaaaaatgacagaaaatatattacaggtaaaaagaaatgatgaattttattatccgattgtatttcggaaaaactttgaagatttatcgaatcagttaaaaacattaaaattacaagaacgaaaatgctgcattgtaacggacagtaatgtggcaccgatttatttagagacagtaaaaaaagaactggaaaaagtttcggataccattatatccattattttaccggcaggagaggaaaataaaacgcttgcacagattcaaaatatttatgagaatttaatcaaagcacatttcgacagaaaagatttactttttgcattgggcggaggagttgttggagatatgaccggttttgcagcagcaacttatcttcgaggaattgattttatacagattccgaccacacttctggcacaggtagacagcagtattggaggaaaaacaggtgtcgacttcttacagtataaaaatatggttggagcatttcatcagccacgtctggtttatatgaatgtgcataccttagatacgctttcagatgaactattttcctgtggaatgggagaggttttaaagcatggattaattcgtgacctggattactttgaatggttaaaagaaaacagagaaaaggttcttaatttggacgaggatgctttgacagaaatgatttataaaagctgtgtcattaagaaaacagttgtagaaaacgatccgacagaaaaaggagaacgtgcagttttaaatatggggcatacagtaggtcatgcggtagaaaaattgaaaaatttcaaactgcttcatggacagtgtgtttctattgggacagtctgcgcatgttatttgtccttaaagagaggactcattacaaaagaagaatatgaatccgcattagaagcattaagagcatatcgtctgccgatttcggttcagggattaaatgcagatgagattttaacagcaacaaagtctgataaaaagatggagcaaggaaagattaagtttgttttacttgaaaaaatgggatatgcctatatcgacaagacggtaacagatgaagaaatgaaagaggcaattgaagtggttttagaagaatcgggagaagaaaagtcatgaaaatgaaaaagacaagaggtatcatttatttgcagttgattttgtcaactttcttcttaactgtgttagaccagtggacaaagcatcttgcagtcacgcatttgcaaaatcaatcagatatttcgttgattgatggagtattgtctctgcattatctcgaaaatcgtggtgctgcgtttggagtgtttcaaaatcggcagggtgctttttttattctgacggttgttattcttgcttttattttatatgtgttatggagaatgccggttacgaagaaatatttgccggttcgtattctttgttttttcctgacgtcaggagctcttggaaatttaatagaccgaatccgtcttaaatatgtgatagattttatttatttttccctgatagactttccggtatttaatgttgcagatatttatgtaactgtttcaatgattgtgttattattattggtgcttttttattataaagatgaggatgattttgcatttttaagtccaaaaaagaggggaaaatgataaatgaaaaaactttgcttacaggcagatgcatcagcagaaggacaacgaattgataaatatctggcagtggaactttcagattattcacgctcatttttgcagaagcagttaaaagagggaaatgtgacaatcggtgaaaaagcagtgaaaagcagttatcagctttcggaagaagaagaaattaccgtgttaattccagataacaaagaaccagatattgagccggagaatattccgttatcaatcctgtatgaggatgagcagcttttagtggtagataaaccaaaagggatggtggtacatccgagcgcgggtcattacagtggaacattagtaaatgcgttgttgtaccattgtaaggggaacctttccggaattaacggggtattaagaccaggaatcgttcatcgaattgataaggatacaacaggagcattattggtgtgtaaaacagatttggcacacagagatttagcacagcagttaaaagaacatagtatcacaagaaggtatcgtgcaattgtacatggaaatttaaaagaagaagagggaacaattgagggggcaattggacgtcatccgaccgaacgaaaaaagatggcgattaatctgaaaaacggaaaaccagcggtaacacattacaaagtgttagagcattataaaaattacagttatattgagtgtcggctggaaacaggaaggacgcatcagattcgtgttcacatgagcagtattggacatcctttggtgggagattttgtatatggtccgaaaaaatgtccattttcaaatctggagggtcagactctacatgcaatggtacttggatttgtacatcctgtcacaaaggagtatctggaatttacagcaccgcttccacaatattttgaaaaattacaaaaaaaactcatataatttatgcaaattttatatacaaaacaaaaaaaatagattataataaatataatcagaaacatcaagaaatatcaatggagaggagtgcatgaatatgacgaatcatacagttattacaatcggaagacagctcggaagtggtggtaaggaagtaggattgcagttggcagaagaacttggaattaaatgctatgataaagaacttttggaacgtgcagcaaaagacagtggattatgtcaggaattatttgaaaacaatgatgaaaaacctacaaatagtttcctgtattctctggtgatggatacatactcttttggatattcttcagcggcatttgcagatatgccaattaatcataaggtgtttttagctcagttcgatacgattaaaaatattgcaaaagaaggaccttgtgttattgtaggaagatgtgcggattatgcattatcagaatttgataatatgttaagtgtgtttgtccatgcagatttagaaaaaagaatccgtcgtgtggcacgaaaaaatgaattgacagatgcgactgcaaaggatcgtattcagaaaacagataaacgccgtgcaagctattataactattatacaagtaaaaaatggggcgatgctgcaagttataatctaagtttagatagtggagtattaggaattgacggctgtgttcaaatgattaaaaaagcaattgaaattaaagaagagcggctggcaaaaaataatcgtgaagtaaaataaaaattgggcagagggaaatctttttctctctgcctttttacgtgacgatttatttttttagaaatgtttcccagccatctaagtttccatttaaaattgcagtaaacatccgttcttttacaccaggatgttcatggtttaaagtacgaatcaattcttttacatattggcgtttggtataaccatccactggacagggacttttttccactggaaggtgatgtttatttttaaaaccaattacatccgcttcatttacaaagagtaaggggcggattacagtaagatctgttcggtcaagatgggttttcggagaaaatgtgtgaaaacgcccctcaaaaagcagagatagtaacattgtttcgataacatcatctttatgatgggcataagcaattttattacagcccgctttttttgcggcatcgtttaaggcaccttttctcatttttgcgcataaagaacaaggattgggttcttttcgttcattaaaaataatctgagcaatttctgtctgtacaatcgtataaggcacatttaattccctacagagcgcttttatttgtatgaggtcaaatccaggatgacctaaatcaatagtaatggcttctattgtaaaggaatttggataaaaacgttttaagccatttaaggcataaagaagggtaagactgtcttttcctcctgaaattccaactgctattttatctccggattcaattagattaaaggtatcaactgcctttctggtaagactcaataatctttgcagggtcatttatttcctccttagctatattttttctgtaaaagactataacacattggaaaaagaaaagaaatattttttacgaaattatgacacaaataataaatttcatgctataatataaacattaagcatttgcaaagagaataaatggaggaaatatatgaagtttcgttgggataaaaagtatttatattggggggtgacaggctttgcagtcatttgtgccagtctgcttttttattttggactgtttcacatggatgtgctatggggaaaagttcataatctgtttactgttttaatgccggttgtctggggtgtaattattgcatatttattaacaccgattgtaaatatattggaaaaaaaggtatttttttcgttattagaacattttcatgttgaacttacaaaaaagaaacgtgtgttaattcgctatctgggaatttttatttcccttatattggcatgtctggctatttattctttatttgcaatgattgtgccgtctattgtagaaagtattatcagtattgtaaatgattcaccaagatacattcagaatattatgaattggctgagttccattttaagagataatgaagaacttcagacgaccgtgtttaattttattgataattattcatttaaagtagaaaattggatgaatcagcagctgcttcctcagcttcgtcagattttacagcagatgacaacaggaatttttggcgcagttttgtttgtaaaaaatattttaatcggagcgattatttcgatttacctgatggcatcaaaagagacttatctttctgagggaaagatgtttatctatgctatttttgatacagagagagcaaattctattatcaaagcatgtcgttatacgaatcgtgtatttatgggttttatcagcggaaaaattattgattctgcaatcattggtgttttatgttatattattacttctattttgggaacaccttatgcagtgcttgtcagcgtaattgtgggtgtcacaaatattattccgttttttggaccatatttgggagctattccaagtgcatttattattttgctggtaaatccgatgcagtgtttatatttcctgattgcaattttattgttgcagcagtttgatggaaatatattaggaccaaagattttaggggaatcgacaggtttgtccagctttatggttattgttgcaattcttttatttggtggatttatgggaatttcaggcatgattatcggagttccggtatgggcggttatctgtacaggaatccgtcagcttcgagaatatttcctgaaagagaaacatctaccggttgaagatgaactttacatggatattgagtccattgaccctgaaagccatacgattattaaattaaaaaaagaagatttaaaggaacaacaaagagaaagcaaagaacatacgaaagagaaaaatatagagaagggaaacgagtaataaatgaaatttgtaatccagaaagtaagtcaggcctctgtttctgtggaggggaattgcgttggaaaaatccaaaagggatttctggtatttgtaggaattggaaaagaagatacaaaggaaattgcagatcagtatattaagaaaatggtacaactgcgaatttttcaggatgaaaatggaaaaacaaatttatctttgacggatgtcgggggtgaagtactgattatttctcagtttacactatatgcgaactgtagaaagggaaatcggccaagtttttttgatgccggagagcctcaaatggcagaagaactatataaatatattatcaaaaaaacgaaagaaacgatttcggtggtggagtcaggagaatttggagcaatgatgcaggtatctctggtaaatgaaggtccatttacaattgtttttgatgagaatacatttcgctgacagaggggaattcattcgtgaaaaataagagattattacaaagtaaattattggcagtaactttgagtgcagctgttcttttaggacagtcaacagttatggcggcagagcttccatctgttgaggacatggaagcaacaaaagagttcaaacaggaatcggatttatctttggaaaaagataagtccgatagttctgtagagaatagagagaaaaaagaaaatactgaagaagaacaagaaccagaaaaaaaagaatttgatggaggacaagatggtattaatttggactccaaagatggttcggaaaatgattcagaaaatgattccgaagataattcaggggatagcgcagagagtaatccggaagagaaagaacgggatgcagatgatgatgataaggaaaatgaaacttcagatgatacaagtgcggctgattcagcacaaaataaagatatagaagaagaaccaaaagaaacagaaaaaattcaattagaagaacagatagaacaagatctgcaggtacaggaagcttcttatggatggaataaacagggcagtaactggtattatataaatcctcagacgaaaaccaaagtttctggctggcagaagatatctggaaaatggttttatttctcttcggctggctggatgcagattggctggcagaaagttcggggaaaatggtattaccttggaaatgccaatgatggttcaatgaaaaaagggttgcaaaaaatacatggcaagtggtattatttttcagatgatggagcaatgcagagcggatggcaaaaaatatctggaaaatggtattattttggagacgcagaagatggctctatgaaaacttattggcagaaagtgtccggaagatactactggcttggtcatggaaatgatggagccatgaaaacaggctggcagaaagtttggggaaagtggttttaccttgcagagaatggagaaatgcagacaggatggaaaaaactgtctggtaagtggtactatcttggcggttctaatgatggttcaatgaaatatgattggcaaaaaatttcaggtcggtggtattatctgggtggggcggatgatggagttatgcgtacatactggcatcaggtgagaggaaaatattactggcttggaagaaatggtgctatgagagatggttggcagagagtctggggaaaatggtattaccttggaagttctggtgatggctcgatgaagagtggctggcagagagtatctggaaaatggtattatcttggaacatccagtgatggagtcatgaaaacaggttggcagacgattaataaaaagaaatattatttttatccggatggtagtatggcaagcaactgtacaatagatggttattacattaatagtaacggtgaaaagagtgactcaaacagtacgttaaatacctgggtgtttccgtgtccgtctattacttatgtatcaagtgaatttggatatcgggaaagccctggtggaatcggctctacgaatcacaagggagtagatatggcagcaccggcaaattcccgtgttttagctgttgcagcaggtacggtggttgcttctggctatggatttaatggagagggaaattacgcagaaatagaccatggaaatgggattcatacaatttatatgcatttaatagcaagtccggttgtaaaaaaaggaagtacagtaaaagccggacaggtgattggttatgtaggaatgactggagcagcgacgggatatcatttacattttggggtgaaggtaaatggaacttatgttaatccgtggaattatttaaaacgtccaagcggaatgtaattgaaaagaagaaaggtttttgatttatgaaaaatagaggaaaaatggttacaaagttgtgtggatttgttatgagtgcatcattgttgatgaatcaggcagtttatgcttctggagagatagcaggtgaaacactttcaggagaagtacagagtgcggaagttcaagaagaaataatgaattcaagtgaaaccttaccgaagatatcccaagatttatccgaagctgaaaatgaagctgaaacagagggagctgaaactgaaacagaaactacagattcagaggcagaatcaaaagaagaagtaagtcagaaagaagaagtgagtcgggatgaaaagaatcaagatgaaacttctgatgaaaattctgatgaaaattctaaagaagaggcattaggagaatcacaagagacaggaaatactattcaaggagagcagcaggcaacactggccggaccaaaaaagacgggctgggttacagaaaatgggaaagaatattattatgacgaagagggtaaaccttatacaaaaagccgtattttagatttaaatggaactctttactatataaattccaatggtgaactgcggacacaggtgggctgggtaaaagatggtgcaaactggtattatgtaacatctcaaaaagcacttgcaaaaaatggctggataaaatctggaagcaattggttttatttaaacagcgatggtgtaatgcagaccggaatgattacggtatatggaaagaaatacatccttcaagagtctggagcaatgttaaagaaaacaggctgggtgcaatatcaagggaaccggtattacatgtatagcgacggacatgtgtttcatggaggatggttaaaggtctctaataagtggtattacatggatacagaaaccggaatgatgaaaaaaggctggcttaaaacctctggaaaatattattatttaaatagttcaggagtgatgcagaccggctgggtaaaatccggaagttgctggtattatatgaatacttctggtatcatgcagacaggctggcttaagtctggaaaaagctggtattacttaagtgcatcctctggagcaatgcagaccggaatgattacagtatatggaaagaactatattcttcaggattccggagtcatgttaagcaaaacaggttgggtgcaatatcagggaaattggtattatatgtatagcgacggacatgtgtttcatggaggatggttaaaggtctctaataagtggtattacatggatacagaaaccggaatgatgaaaaaaggctggcttaaaacttctggaaaatactattatttaaacagttcgggagtgatgcagaccggctgggtaaaatccggaaattactggtactatatgaatacttctggtatcatgcagaccggtccgattaaagtaggtggtagctggtattacttaaatccgtcatcaggagcaatgcagaccggatggatggaagcggatggaaagaaatactatgtaaaaccatccggtcaaattagcattggctgggtggggattaataatgtttggtattattttaattcaaccggagaaatgcagactggatggcagaaggtaaaagaagaagaagaatggtactatctggacaagacaacaggagcaatgaaaaaaggctggtttgaagacggtgatagctggtattatttaaatgcttctggaaaaatggtaaccggctggcagatagttggtggagaacgttattacatgaatagtgatggagtgatgcagacaggctggttggaaatgggagataagagctattatctgcagagcagtggtgcaatggcaactggaatcctaacaattgacggagtaaaattcaaattcagcgataatggtgagctgattggttctatcagcgaagagggagtaggcgcagatattgtggcttatgcacgtcagtttgttgggaatccttatgtatatggcggtacaagcctgacaaatggagcagactgctccggatttgttcagagtatctataagaaatttggaattacagtaagacgtaccagttatgagcaggagagagatggaagaccgattacaagacaggaattacagccgggagatttggtgttttattatagcgactattctcatgtagcaatttatataggagatgaccagattattcatgctgcaaatcgttcaaaaggcatcacaatttctcggattaattataatggaaatccgacagcatatagaagatactggtaaataaaaaaagaatcccttttatccgtttcgctatatctatggttgaaatttaagataaaagggatatgttattaaaaaatataatgttatagtatgaatattatatataacaaaaacaaacccctttacacacaaaaaaagaaaggagcttccacatggataacaaaaacgataaaaatcacttctttgaccccgaaatgcaaagtatttggaaacattttgtttctcacttcagaaaccaaaacagtgcagcatcttatcgaagtgataccatcgaatttttggaatttaccgaaaaaagttttcttgaaacaacagcttctgacgtggaaaattactacgccattcagcaaaaaaaaataaatgaaaaagaattacagcctagtacagttgccaaaaagataagagaattaaattcattatcaacatatatcgaagaaaataaagaatattatcatataaaagacaattaccaaaatcattttgcggcgtatctgcctcatattgaaaaaatgagtaaatttgctcattctgttccgatagaagatattgataagctgttaattgcagctcaacccgattatatggtttactgtattattacattgttatatcgaatgggattatcgtcaacggagatagtagagcttatgccagaacattttacgatttatgataatggtgtatatctaaggataccaaaacgacgagaaacctgttttgtaccggaagatgtctataaaattatagaaaaatacttatcacagagaatagaaaataaataccttttctataacagcagaggaacaaaattaaatacaatgtatatcagtcgtatgatgaaaaaatatacgacactggctggaattccatcgtacagtgcagaaagtcttagaaattcatgcgcttacacaatgtttgcttatgatgcgaaaccagaacaggtagcaagagaaatgggagttacagaaagccagattcgtcgttataagaatatgaattatatggatactacttcaagagcaattcgtggactggtaaaattaaaagcagaaccaccagaataacataaaattatattatgtaaactgtaaagcaccgaatccaagataatcagatattaacaatcgaaacccctactgccaataacaacaatgataaaaaagacccgaagctagttaactttaggtcttttttgcatactatataaatactatatgtagtgaattgcaatatccatttgactcattgtaaatttccattacggatgacatttctgacacgcttcatatccctggtctaacaaatcctgtctatttccggtatatttcttacgattttccggattcatttgttttgcacttggacagtcctgcgtatgaaatttcattgtattttcatttaaaatgtaagtcgtttcatttgaggcagaagtattattagatgtactgtctgtagataaataactatctcccgtggcataatcaatagtaatatccggttgtacattataacaatagacattaaataaaatgccatcaccattatcttcaacggacatagcttccatttctactccagatgcaaccaaattgtcacccttgaaaataggagtaacacggtataacacatgatagtcagtttcttttacataatccgcaatcatattttcaaatgggagcatcccatcaacgttcatatatctggtaccggtaatcaaattcttttcatttgcattttcaccggctaactgccagccaatcaaatgacaacggttatataaagatttcccatctacattatcatatcttacagagtgccatccggttggcttgacctgactgatagaaccacgttcctcggttggcattaaatcaatacagatatttgcataagcaactccgcatcttcctaactcatctaaatcactataattttcaaatggttcttcggttaaatctgcatctgtaaaaaatggctgattatcattaattacaacataaggtttaccggaatattccggtatagaatccaattgaatatttttttcatctgagctaacactgatatctgaaggactgctttgtacagttgtctgactgctttcagaagtaattcctaagtttccctcaacgtcacagcctgtcattaaaaacatcaggcagagtagaagagtaagccattttaattgttttttcatagttttccctcgatttctattcttctgccagttcttcagcaagagatttcttaattttctttctggttacctctacaatgtttaattttgtaatatctaccacatttccctttactgggtcttcatttaaataacgctgaagtacatgcatcagttcttttttatcttcttctctttttaaattaataaaatcaatcaaaatcatgccggaaagattacgcatacgaagctgtcttgcaatttcgcctgctgcctcaagattaatttttcgataagtttcctgtacttctttctttccggtatattttccggtatttacatcaattgaaacgaaggcctctgtctgttgaatcaccagaaatccaccagactttaaccagactttttcagaaagtgcctcttttaacgctttctcaattgaataaactttacaaagcggaagtaaatcatcctgataaaaacgtaatttctttgcttctattccatagtgctctaaatagatttgaatcgtttcaaatagttctttgtcgtccgtgacaatttcttccagctcatctgcatacaaattttgaagaacctgaagatatggcggcatggaaataaaaagttttgaaaaacaggttctcattccagattttttttgaatttctttcaattgaccataaagcttgtctaattcttctaaaatctcaccgccttctgcatgagcactgtttgtacgaagaatgactccagcatcttctggaagatgagcttgtaaaagttctcttaattcctgttttctctgtgcttttaattttccggaaaagccaagcggttcaaattttgaagtcaaaacaacataacgccctgccagatttaaatcacaggttacgcaagggagtttgccgcgaatcggctctcggcacacctgtactaaaagttcgtctccaatacaaactcgattattttttttctgatttacaaaaaatggctctgctttttcctctaaggaataataacagataattccattttcaatttcaataaaagccgcacgaatgttttcggcaatattttttacttttccaatataaatatttccaagaatagatgcttcctcttttttataaaggtcaagctgacagattttatagccgatatcaagtgctacgacaattttttcttttcctttgacatgcataggagtgataattaatttactcaatttcttctcctaaatcctctaaggaaaccagatttcttgcttcgtcactaccagtatctgcataaagctcacaacgatgaatcataaattttagattctcataagaaatctccataaatgccgcaaatgcttccatcacaagttctggttttgtattattggagctgcctgctgcaagctgcataaaaatttcatccttttcttctaaagaaagtttataaataaatggacgaatatctaattctttttcactttttttcgttttctttaaaataacaatttctttttgtgctttaaattcttctaatttctctttccagttctctggaagttttgcagtttcacggaattttagacgataatctgctgctgcaaccagcgacatggctttggaagctttaccatcctctacctggcggatgcttaaaatcttcatcccttctgccattgcatcatttaagcgttttaccatatcagaagaagtcgttgcactttttaattccatatcgaagtattcaccggtacttgtaattccaactccgagaggtgaggcaaatgacataatcatatgtggactgaatccttctgaaaatgcgacatctaaattggcacgtttgactgccttttgaaaatagcgcataatatccagatgaccgataaatttcatagccccttcttttgcaaattttaccctaaccttcaacgcatacccctcctttgtattttcctgcaccacagccggaacatttcatacggcagtttggcgttactgtttcttccattgctgttttccattctctttgtaaaaatttctttgttacgccggcattgatgaagtcccatggcagaagttcatcaagcggacgctgtcttagagtataaaattcagggtcaatatttaattcttcaaatgcttccatccataaatcatagcggaaatattcggaccatgcatcaaagagagcaccctttctataagcaagctctaacacatcggcaactttacggtcacctcttgctaaaattccttctaataccgtaacatctgcttcgtgatagttatatttaatactcttttgatttaactgggcacgaatttctgattttacgattttagcacgttcaagatattcttcttttttacacatcgaagcccactgaaatggggtaaatggttttggaacaaagaaagacgtacttaccacaatctgacatcttccatgacgttggtcttttggaatttcataatatttttttgcaacttcttctgccagatgcgcaattcctttcatatcttcttccgtttctgttggaagtcctaacataaaatagagttttacacgagaccagccaccctgaaaggctttaaaagagccatttaaaatatcttcctgagtcagacctttattaattacattacgcattctctgtgttcctgcttccggtgcaaaggtcagactgctctttttgatatcctgtactttactcataacatccaaagaaaaagcgtcaatacgaagcgatggaagcgaaatatttacattacgctcggaacactcttcaattaaaaagtcaattagctctggaagcttggaataatcactggagcttaaagaactaagagaaatttcctcatgtcccgtactttccagcatttcttttgcggtttcctttaaaaatgctacgtttttctcacgggtcggacgataaatcatacctgcctgacaaaaacggcatccccggatacaacccctctggatttccagtgtaacacggtcctgagttgccttaataaatggcacaacaggtttctttggataacagacattgacaaaatccataacgacctgtttatcaatcgtttcttttgcatgttcattatttggatgaaatgctgcaagtgttccatcctcgttgtattcggcatcataaaatgccggaacatataaccctggaatttctgctgccttttccaaaaattcttttctgctctttccggagtttttccagattttatattcatctaacagttcatcaaatacagtttccccttctccgatataaaaaatatcaaaaaattttgccagcggttctggattgtacgcacaaggtccgccacccatcacgattgggtcatcttcacttcgatcagaagcatgaagcggaatctggcttaagtctaaaatctgaaggatattggtatagcacatttcatactgtatagtaataccaaggaaatcaaaatctttaatgttatcttgcgattcaagcgcaaaaagtggaatattttctttccgcataatggcatctaagtccggccatggggaataaacgcgctcgcaccaggtatcctcgcgtctattgaacatatcatataaaatctgaattccgagatgggacattccgatttcgtagacatccgggaagcacatcgcaaatcgaatgtctacctcatttttgtttttcattactgaattgatttcattcccgatatagcgggctggcttctcgatttctagtaatatttcatcacttaatgctagttttctcaatttttacctctttctttttgtgcaaagcgtataagctttaacccactcacaatgcgttgcacgttttcttacctctttttgtttttacttaaattttgagcatttttataaatttcttacactttttttgaatccatttacactcctatctagtgccgaaacaaatagataacaggagtggtatgtacatctttagtgtaattttccttacaagtatatagtaatacttgaatttgttcaaccaaataaattggaaaatctctttttttgccggttttatgttcttttttgccatttcaagtctttttattctttatttttaagtagtgtcatcattcccagaaccgccggaattatcagaagcagggttatccacacactctggaacaataaccaggaaagaattgaaaagataacgaaaataattagtttcatccatgcatctacctgcagttttcttttttggaacaggaggcaggaactaaccagggtaaccaggcagactaagaataaaataaaaatccctgctgctagaagaaatgcaattactccagtcagaccgccaagcatagtagtgaaaactcccgaaaggactaaatgaccgccgatgtaatcagacatggtttctgattcagaaattatatgtgctccagccgttgttatatttttcgcataaaacagaaatatagcaattcttgcttctacgattgcaaggaatagggtatatattccaataagtaatgttgaaagccaggctgttggtggcagtttttctttttcctgcatagtgaatcatcctgtctgctttatataatcttatagcgttttaaatacttttcattttgaacttgaatgtctttgtattctgtcagcaaattgtagaaggttgcttttttaagtcctgatttttcaataaattgttttgatgagatttccccattcctccatttttcatatagttcatcccagttatctgggaacggcaatttatttcttcctgaatttgctcttttaaaagaaacagtaactacattcttattatcacttaatattgattccaatatcgtatttaaaacagcttgattcattggctgtgttactccaaattcataagtagatgtaacatcacagataacaagttttacagaattatcaataaaccatgaaagctgggcagcaatatcggcatcatttagtccaagagaatttagggaagaaacaacaaagatggtatggtcgtcaatcttttttatctcattgaatgatgtaaaagaccttttattttcacttgtaaccagcaattcatcctgctcttttttgattgcttttattacattatcaaaaatagataagggttcatgtaattttacatataaatgtatcgtcaataaaatcattcctttccaaatagtgaaaatttactaagtttatgtccacatcttttttcaaatacttttctatcgattgaaattttgcagtattcacgggtaaacaatatttccgctttcatttcagccggaagtaaatttttccatgaattaatttttctctgactatctttatctatcccacattcaatcaataatctgtcttttgtaagtttataagctttcttgttatttttacaaaaagaagcaatctcgtgtacaatttcatccgcattagaatccatagaataatcatcattccaggttaactttcttataatatgaaggcaacgtataaccataatcctcaaaaatagaaatgattacttcagatgatagagccaaaagttttgggtaataatcgtctggaaattcttttgagtaaataataaaatccaattcctcttttgccttatccatcattttgctcaaatattctcggtaaaacccagtgcctagttttcttataatcgattttcctctgcttgcataagctgttttatctattgtacttggcaatgctccatccatcgcaaaaaatatcattcgttttctaagaggctcatctggtttcagaacatcattacttgcaaataaaatcataggcatatcttcgagttgattttcttcacatttttcggggttcttaataatatctttgattcgagagatgtataggttatctatttcatcaataaaaaaagggactcccttcactgcaagttgtgtctctctgatattatctttcgaatagtcacaagcttttgttccatctaattctttgccagtcattaattttaatgcagcttttatcataaatgtctttccactattagatgtttctgatgatataagtgcaaacaaaggcaaggagtctgtcgacactccttttattttggaggcacatctaaattttgcatgaaacggtgagcaaaaaattgcattcattaatttataatgtgtatatttaagtttttctatgtcagatgaaacaaactgttcaaaattatgaaatatcccaattatttcattgatatcgtgctttacttcttcatctgtaggattcaaatgaagttgtttaccattaagaaaagcttctccatgatataaatccaaagtcaaagaaggatatcgctctgttatattacgtgttttcattttcttttgcaataatttcttttgattatattccattttttcaagtgttttgggcacaatttcaaacagccctgttttcgattttggttttacatcccctaaaagggcttgatatttttctttgattgctccgtggtctatggtatatttaatattgtcgaatgatatgtcaccttctggctgttgtaatacaattgcatgacctgtttctttaatgccttttaaaataacattctcttcaaccaagttatctgttttctttgatgaaatcacatccattgtaattgcttgtgatatatcccaagctgtttcaaaatcctttacatacgcttcgtaacattctttcgaatcatcgtattcataatgttctatatggtcattattccatgcttttttcgaaagatttgcagatgctttaatgactcgtgttctgccattatctgattttaataaataaatttttctatggtctaatacaaaagatggagttttaaattcaatatcaccgtctgtaagcatgtttgctaatttatcatacttctggatggctttgcctgcttcataagcatttgttaaaacttctgctaataaatcatttaatttcccatctttttgaacaagaaaattaccacctagaattacttctccataatcgaaatgttccatcaactcattgatgaaaccgatatcataagaaaacgtaattgccttaatcatattaaatcctgaaaataaatctttcaaggtcatatattctacggattgtaattctgatttaaaacattttaagagctcatcatctttcgtactgattccctcaattactgaaaaggcatcatttgcaaacaagttcatttgtccatccataataggttctccttgtctaaaaataaattgtattttttagactattatatcttgcgtctaaaattaaatcaatatttttggacaaaaaaatttcatttcttttataagaataacttttccatgtataagcatgtataaatttatacttttcccattcgattcttaattttttcttataatttttcggagtataatataaaaaacggggtattttatgttagatgttctttggtaataatgtgtaaaaattgacggttttaggattgtttgatatactatttactgtgtcggtttatgtgtctatttttataataaatttgacacacatttttaaataattgaatttttatgtttgtatgtacttgctaaaataaaaataataggaggattggtatggcaaaaattcttttccttatggatgatacaacgcacattgataaaacagaattgctaaacaagaaatataacacaaatggaatttcagattttcttaataaagaatttgaaaggcaaaaagcagagaataacagcctggtagaagttatagatgctgattttttagaggtattacacaacaattatgaagcagactgtttctattcagaaagacttccagagggagtcattggttcttatgctgattttgccaaagattttgatgattttcatgactggcagaatcaacttttgtatgattttgcaaaagcggatacagatgtagttttagcgggaaattttattttcttccgtttttcaaaggagcagaaagagaaatggttttccaataaatatgaggaatttcctaaaattgttgcaacagtaactgctgagaattttcatgaatttgcgaccatcaacaaattgcaggaaaccatttcttccagtaactctattgtgtcttatgtcatggatggaatgagtgatattcatcgatttgatgatatgattcgtatgattgactctaatgagtggtatgtcattgaaaatgcaatcaagctttcttttgacgaagaaaaataaactatcatttacagttattattcaattacagaaccccatctttctatataaaacagacagacggggttcttatatttgttttattatttagctattgttttattcgttaattatatcaatctgacacattttcattgtttccagtgctgatttatgagtttgtggtgtgacaccagcgcagcaggatgcatctactgtaatctttaattctggaaaaacagcctttaaaatcaatgcattggatactacacagatgtcagtacaaagtccgattaattcaatctcattgtcaaatttctgctcttcccagtgagaccagccaaatgttggcttatcaatgtatgtagctccttctacttctaattcttccgctatctgccatccatgcgtaccataaatacaatgttccactggcaatttcttaccttctggagtattcagatagtcgatttggtgggtatccctcgtaaaaataatgttatctccacgtttttgatattctttaattttttcttttactgtcggaacaattgtctgtgcttcttttgtgccgaggcttccatcgataaaatcattctgcatatctattacaattaatactttgttcatttttttattccttttctaaatttttttaacatttatttaagtatacaattctttaatagatttgacaagttactgctttctatgcaaaaataagaaaaacagaagggggtatttattatagaagttattcttactttagaaaataggaatgggatgctttttaatcatcgtagattaagtcgtgataggagagtttgcgaaaaaattttagattattcaaacgagaaagaattatggatgaatgcttattcacgaaaattatttacagatttaacagatatcaatagtattcaagttgacgaagaatttttagacaaatcacaatctatttgttttgtagaaaatcaagatattacgccttatctgcctaaaatcgatacgcttgttctttttcaatggaatcgtgactatccggcggatttcttttttacagtagatttatcacaatggaatttaatttctacagaagactttgagggaacatctcatgagaagattacaatggaggtatacaaaaaagatttatgaaatccatgcttacaacgctttgctatattgaaaaagaagaccgttatcttatgcttcaccgcatatccaagaaaaatgacgtcaataaagaaaaatggataggtgtcggaggacattttgaaaaagatgagagtccggaggactgtctgttaagggaagtaaaagaagaaacaggtcttgctctgacttcttatcatttccgcggaattgtaacatttatattaaaggataagggttctgaattaacggaatacatgtgcctgtataccgcagatgactatgaaggaacactttgtgactgcaatgagggagtcttaaaatgggtcgataagaacgaaatctttaacttaaatctttgggaaggagaccggatttttttgagattattacaggagaatcatccatttttttcattaaagctggtttatgaagggaactgtttaaaagaggcagtacttgacggaaaaagaatttagaaaaaaaatgtattttttcagcaaaagatattgacgaatttaaaaaagcgtgctaagatattcgagtatgccgcacagagaggttttaagcactgtgaaaaagtcagtcaccatattctggcgagtaatgataataggaggtgccatatgtacgcaattattgcaacaggtggtaaacagtacaaagtagccgaaggcgatgttatcagagtagaaaaacttggagcagaagctggcgaaactgttacatttgaccaggttcttgctgtaaacaacgatggtttaaaagttggcgaagatgttgctaatgcatctgtaactgcatctgtagttgaaaacggtaaagcaaaaaaagttatcgtttacaaatataagagaaaaaccggataccacaagaaaaacggtcatagacagcagtttaccaaagttaaaatcgaaaaaatcaacgcttaattatgacaaaagttacattttatcaaaaaaatggtgttgtaattggatttgacgcatgggatcatgcgggatatgcaaatgcaggtgaagacattatctgtgcagcggtatccgcccttgtcttaaatgcaatcaattccatcgaagcttttacctcggatgcatttacagcagatgtaaaagaagaggatggacggattgaatttcgactggagcaggataacccctctgatgatacaaccctgctgctgaagtctctaatcttaggacttcagggaatagagaatgaagaagaaaatatgcaatatattgatgttatattcgaggaggtgtaaggcatgttaagaatgaaccttcagtttttcgctcataaaaaaggtgttggttctactaagaatggtagagattccgaatccaagagactgggcgctaaaagagcagacggacagtttgtaaaagccggaaacattctttacagacagcgtggaacaaaaattcatccaggtgtgaatgttggacgcggtggagacgatacattatttgcattagtagatggtgttgttcgttttgaaagaaaaggcagagataaaaaacaggtttctgttgttccagtaactgcagaataagttttaaaaatgaggcttcaaatcgttcaggtttgaagccactttttatatattggtaaacgtaggaaaagtggacttgtccactttattttatatagattataaagaaagatagaggttattatgtttgcagatagagcaaagattattatccgctcaggaaaaggcggagatggtcatgtaagcttccgtagagaactctatgtcccaaatggcggaccagacggcggtgacggaggacgaggcggagatgtcatttttgaagtggataaaggcctcaatgcccttacggactatcgacataaaagaaaatatgccgcagaaaacggacaggaaggtggaaaaaaacgctgtcacggtgcggatggaaaagatattgttttaaaagttccagaaggaacggtaatcaaagaagcaacttccggtaaagtcattgcagatatgtctggcgaaaatcagcgtcagattgtattaaaaggcggacgtggcggaaaaggaaatatgcattatgcgacagctaccatgcaggttccgaaatatgcccagccaggacagccggcacaggaattagaagttcagttagaattaaaagtaattgctgatgtcggacttttaggatttccaaatgtaggcaaatctaccttcctttcaagagtcagcaatgcaagaccacagattgccaattatcattttacgactttaaatccgcaccttggagtggttgatttagacgattgcaatggatttgttatcgcagatattccaggactgattgaaggagcttccgaaggagtcggacttggtcatcagttcttgcgtcacattgaacgttgtcgtgtcttgattcatttagtagatgcagcttctacagaaggacgtgacccaatagacgatatttacaaaatcaacaaagaattagaagcttatgacccaaaattaaaagaagttccacaggtcattgcagcaaataaaattgatgcaatttattcggaggacgaagaccctgtagaaaaaatccgtcaggaatttgaaccacagggaatcaaagtatttgcaatttccgcagtatccggaaaaggagtaaaagagctgttatattatgtaaaaggactgcttgataccattgagaaagagccggttgtctttgaacaggaattcttcccggaagatatgttaatcacagaaaatcttccttatactgtttatcaggatgaagaggacgagcatttattccatatggaaggaccgaagattgaaaaaatgctgggttataccaacttagattccgaaaaaggtttctctttcttccaacgtttcttaaaagacagtggtatcttagaagacttagaaaaagccggaattcaggaaggcgataccgtccgtatgtatggatttgattttgattattataaataaaaaccagaaaggggaagataatatgacaagtaaacagcgtgcttatttaaaaagtctggctatgacgatggacccgattttacagattgggaaagcaagcctgactcctgaaaatacagcatccgttgcagaagcacttgaagccagagaactgattaaaatcaatgttcttcaaaactgcatggatgacccgaaagaaatcgctcaggtattagcagaacgtacgaaatcacaggttgttcaggtaatcggaaagaaaattgtcctttataaagagggcaaaaaagaaaagaaaaaaatcgtacttccaaaataattaaaacagaacacggttttggttttgtatctgccagaatcagattagataagaggcaaattatggataaacaaaaaaaacgaatcggcattatgggtggaacatttgacccgattcatatcggtcatctgatattaggagagaccgcttatgagcagtttcaattagatgaagtgctgtttatgccatctggaaatccacctcataaacgaaaccgagcacaccgtgcaacggatgaccaaagatgcgaaatggtaaaacgtgcgattgcttccaatcctcatttttctctttctttagaggaaatgaacgaagatggttttacttatacctatcgtactttggaacgcttaaataaaaaacatccaaatacggaatattattttattttaggtgcagattctctttttgattttgatgaatggaaagaacctgcacgaatctgtcaggccggcattattgtagttgcaaccagaaatcataccaaagaggaagcgttagatgagacgatttcttatctgacaaaaaaatacaatggtagttttaaaaagctgaaaaccttaaatattgacatttcttccgctttactgcgttcctgggtcgcaggtaaaagaaatatccgctattatattcctgacagcgtaattgagtacatcaaacaaaaccatatctacgaggaatgtgatgaacatgcaatatgatttaaaagcatttgcaaaaaaagtgaaaaagcatcaagaaaaagagcgttatgaacatacaaaaggagttatgtatacagcagccgcactggcaatggcttatggctgtgatttagaaaaagccagagttgcaggactgctacatgactgtgcaaagtgtataccggacgaaaaaaaaataaaactttgcgagaaaaataagatagaaatttcagaaattgaagctcaggctccttttcttttacatgctaaattaggagcgtttcttgcaaaagaaaaatatcaggtagaagaggaagagattctttcttctattcgctggcatacaaccggaaaagcagatatgacgatgctggaaaaaattatttacattgcggattatattgagccaaacagagagaaagctccaaatcttgccaaaatccgccaaactgctttttatgatattgatgaatgtatgtatgagattttgcgggataccttagagtatcttggaaaaaatcctaaaacactcgatcctgaaacgaaagatgcatttgaattttatagacagttacatgaaacaaagcaacaagaaaaaaaggagagcgctttatgacaagcaaagaacttgcaaaattagcctgtgatgcattagacgataaaaaagcacttgaaattaaagttatcaacattgaaaacgtatctacccttgcagattatttcattatcgcaagcggaacaaaccataatcaggttcaggcgatggccgacaacgtggatgaaacactcggaagagccggatatgaaccgaaacaaattgaaggatatcagaatgcaaactggattctgatggattacagagatatcgtgattcatatcttcgatgaagaaaaccgtttattttatgatttagaaagaatctggagagatggtactgttgttgaagtagaagatttaaaataaaaattaatcaaaagccctgagaaatctattttactttctcaaggcttttttgttatactttatctagttagcagctacttaatttacgctgtactagtagagttacatctcttaaaagataaaagccaaagtataagaacaaaggagaaacaacgctatggaatttgataaaaatctgattctgtatggtcctccaggaacaggaaaaacatactataccatactttatgccgttgcaatctgcgaagaaaaaaatttagatgaaatagaagcacttccttacgaacaggtactaaaacgctatcaggaattaaaggcgaaagaaaaaaggattgcctttactacctttcatcaatcgtatggttatgaagaatttatcgaaggaatccgtccgaatctaaatcacgattccaatgatgtggaatatacgataaaagatgggatatttaaagcattttgtgggagggcagaacaaaaaaaggcagagacaaagaaaacaaaaattagaaatgaagctcgtgtctggaatgtcattctcggtggaacggaatatccagagttaaagaaaaaatgttttgaggagggaacgattcgaatcggctgggatggaagtccggaaatcatcaccgaagataccggaaatttaaatgataaagaacgtcgaatcttacttaattttcatcaggaaatggaaatcggtgatattgtggtggcacgttccacagcaagtgcggtagatggaattggagtgataaccagcaatgcagaatttgatacttctattgagagatatccaagaaaacgtatggtaaactggatttgtaaaggtaaagatatcgaaatcattgatttaaatggtggtgtcagactcgacagaaaatcagtatacgaattagtaaggattcatgtgggagatttattaagcaaaattccagcagattctgacattgagttaaaagaagaaacacgaccttatgtatttattatggatgaaattaatcgtggaaatatctccaaaatttttggtgaactgattactttgattgaaccggtaaaacgaaaaggagcaaaagaagcaatggaagttattctgccatattccaacaagtcatttggcgtgccaaataatgtgtatctgattggaacaatgaatactgccgaccgttcgatttcacttatggatactgcacttcgccgccgatttcagtttattgagaggatgcctgatgttacagtccttagaaaaatgggcgcagataaaattcgtgtagaaggagtagaacttgatgtggcacttatgctggaatgtatgaacaaacgcattgaatttttatttgaccgagaacacacgattggacatgctttttttcttggtttaaaagatgaaacgacgataacaaaactggctgatatctttaagaaatctatcattcccctgcttcaggaatatttttatgaagattacagcaaaattatgcttgtacttggagacaatggaaaaacgcaggatgcacacaaatttattcttgaaacaagaacaactgcaactactatttttagaggcgatacatccgattttgatattcctgagtattcttatcagattcaagattctgcgttttttaatattaacagttatattgaaattatgggtgataagaaattggagaatgtatgatgcaggttctggaagtacgagaatttgaaaaaatcattgaagcaaatgagaaaaatcaaaacttaaaaaggtttgataagcaataccaatgccttgataaaaagacatttcatgagtttcttgaatttattcatgagtttgagcaaaaagaagaaaactcagatattttaaacttcataaccattggatataagaaagcactcggtcagacaatcacattcaaaaactacgttgggctgattcagctaaaaaagaatgttcagatacagattcttcctaaaattgcatttttaaaagaagaaaaagatgaaacaaagaaagtattcttaaaaatgcttcgcagtatgaaggatttttctggtaaaacagctgcaaatgccaatttaaatccagaaaacatgaatttatatgaaatatttatcaacttatatattcaagaagtccgaaggcttgtgaaaaacggaataaaatcatcatatctcaatcaagaagaaaatcttaatgtttataagggaaaacttttggtaaatgaacatctcaaacaaaacattgttcataaagaacggttttacgttgtatttgatgaatatcaggcaaattgtccccaaaacaggctgataaagtcaactctattaaaattgcaacaactcacgggcagtgcacaaaattcaaaagagatacgtcagttattggtatcatttgaacttgtagaaccatcaaaaaattatgaaaaagatttttcaaaagtcgtgatagatagaacaaccaaatgttatgaagtgcttttgaaatggtcaaaggtctttctaaaaaataaaagttttagtatgttttccggaacggaatcggctcgtgcgttattatttccaatggaaaaagtatttgaagcttatgttgcaaagaatttaaagaaacgattgaatcaagccggatgggatgtatccattcaagataaaggctattatttatttgatacattgaatggggaaaaatatcaaaaatttgctcttagacccgatttagttatcacaagacctgacgaatcaattatcattttagatacaaaatggaaaagtctgataaacaataaaaaagcgaattatggtatttctcaggctgatatgtatcagatgtacgcctatgcaaagaaatatcaagcatcagaagtatggctgttatatccaatgaatgaagaaatgagaaatactgagcccattttatttgatagtggggatggtgtcagagtttctgtgtttttagttgacgtcgcacagatagaggagagtttagaaaagctttttctggcattcgcatcaaaataaaatgagaagaattccaaaatatacattacatcaaaagctgtcagaatgaagcaacatgctcgcccccaaaaagctgacaacttttgatgtcgtaaaaaatgaaaatgcctgcccaataagaataacacaaatagggcagcaggagtttctttatttcataaaacgaaatactcctatcacttttcccagaatctgaaaagtctctttgtctggatttaccagaatcggatccatataatcattttctggttgaagacgaatatgctcttcttctttataaaacgtttttacagttgcagaatcttcaattaaagcaactactttttctccattttcaacggtatcctgctgcgcaaccataacataatctccgtcaaaaattccggcatttaccatactgttcccctgaacaacaagcataaaagttggctgattcggtaaaaactctgctggtactggaaaatatccttctgtattttctacagctaaaagaggctgacctgctgcaacttttccaatcacaggaacgttaatcgtttcttttcgtacctgattaaaattattatctaaaatctcaattgcacgaggcttcgttgcatcacgctttatgtacccattcttttcaagcgtttctaaatgtgcatgaaccgaagatgttgatttcaaatgaactgcctgacaaatttcacgtacagacggtgggaatcctctgtttaaaatttcttttttcatatattctaaaatctcagattgttttttgcttattttaccatacgtcatctatttaaatcctcccgaaactctgcttaaaataaaggttcttttccttctcatcttagtattatcatatcatattcatagttataatgcaaacaaatattcggaatatgtgttcgcttacaaatgagatttttacttaaaagttacaataaacagtatataacagttgacaacagtattcatctgttatatacttgtttattgtaaaggagagattttataaatatgcatattatactgaatcattcatccatggtaccgatttatgaacagttaatggaacagattaaatcagaaattattcagtcaaaccttgtagaaggtgagggacttccatctgtaagaaaacttgccggagaactccgtatcagcgcattaactgtaaaaaaagcttacgataagttggaagaagaaggatttgtaacaacaattcatggaaaaggcacttttgttacagcctctgataaacagttagcagttgaagcaagaaaacgtgcagtcgaagaagaatttgacaaagcaattgataaagcagtttcggttggaatgaatcaaaatgaaattttagaacttgttcagctgttgttagatgaaaaataagaagaagggagagtggcttatgatagagatgcaggaagtggataagaattataatgattttcattttcacttatctatgaaaatacccaaaggacaaattacaggattaattggaaaaaatggagctggaaaaagtacagcaattaaactgattttgggacttataaaaccggactccggtacggttaaagtttttggaactccaataaaaaaattagaaccggataaaaaacaagctatcggtgtatctttggctgaatctggatttagtacacaacttacaatatcggatattgaacgaattttagagaagacctatattcattttgaaaaagaaaaatttgaacaaaaatgtaaacttttaaatctgccaaaaaagaaaaaacttcaggaattttcaacaggtatgaaagcaaaattaaaagtgttaactgcgattacccacaaagcacgtcttttgatattggatgagccaacctcaggacttgatattgaagccagaacggaaattttggatttattaagagattatctgatagaagatgagaatcggagtattttaattacgtcccatatttcagctgatttagagacactttgtgacgatatttatctggttcataatggaaaattgatgctccatgaaaaaatcgatgttattttagaacaatatgggattttaaaagtaacgaaagaacagtatgaaacacttgataaagaagcaattttaaagatacaaaaagaagcttatggctatgcctgccttacaaacgataaaaactattacttggaaaattatccacagatagcagtagaaaatggcaggattgatgcattgattcttatgacgacagggggatattaattatggcaggattgttagaaaaagatattcggttaatcatgcagagaaaacagatgttactgctatttgttgtaattgcagttgtgttaggtttttcacaagatggtacttttattttgggatatctgtctttttgcgcagcaattgttatggtaagtaccatttcttacgatgaattagaccatggatatgaatttctaatgacacttccgattacagcaaaaatctatgttaaggagaaatatctgttttgtattggtggtgcggttattgcatggctgtttgctgctattctttactttgtatccaagatgatacgcggagaacgcttttcttttcttgatgaattgccggttattctcattttcttaccaatcattttattgatgttgtctattttgattccattccagttaaagtatggaatggaaaaaagcagaattattttaactcttttagctgggattatagctgcaacaatttattttataaaaaatttaattgatggaaaccccagaattttaacagccataaattctgtaaatgatgaagtagtaactattattttatttgctttggggattttcgcgacattgatatcttattttattagtagtcgaattatggaaaaaaaagaattttaaaaaagacagctgtcggtttttgataccgatagctgtctaatttttcaagcctaatttacataatatattattacgtaaactaaagttaaataagtggatttcaaccgccagtatcgagtcttgggtgcctgccagtaatggcagttgctaagcgtagacagcgagaaaatagagagtgtgattgggcctcgaaattttgacatctagaaggctgacgctttaattccagcggaaagcaacacaaatcaaagtgaattcgttgccgatataggacattacaggagaacacctagatacagataatgagtatatgtattattattcggttgagtttgtaaaataagaatagcaaaaagagagaagaggatgccatggaatcgttgatttgatgattccgtggcatcctcttttggaggggaaactggatttatgatattgtggattttagaacttgtttcttatctttcggtactctcttggggaatatcctttcagcttgtggaaaagccggctgaaataaagctgattatcatacccgacgattttagaaatttcattgatggaataggttgttgtttcaagtaacatctgggcattgttaattcggattcccacaataaactgcattggtgtagaacctgtgtattttttgaagtttcggataaaccagctgacactcattccacgtgaggcagcataatcatctatgctaatattctggttataattttcgctgaaataggtaactgcagtgttcatttcctgatccaggtattcgtttttcagaatatgttcccgtgtcagttctcggtggaaagtgattagtagatgacgaagcagaagaacaagcatttcctcatagttgtcctgacagcgttgaagctctatgataatacgcttgaaaacccgttcatattccatagatgtgccgacttggaaaacccgttctttatccgggaatccatactgacgtaagatatttttaatattgctgcctgtaaaatgaatccagtatacttctgtcttatcttccccataatattcatatttctgaagttctttcggcctgtacagtacaatattaccggcgggaacaatcgtttcgttatctacattgtcaaaatgaaaatgcccacaaccagcggtgatatagatgatctgataatccaggcgtccccttggacggtaggttggtaattttggatggctggaaaggcgataagtgccacagcttcctacaatcagtgggcgacttttgtctttgaaatccatatgggagtggttcagataaccagtattcatatacatagggcagcacctcttttcctgctttttaccattgtatcatttagtgcatattttgtctaatccaattcatagacatattttgcggattaggataagctatgtatagcaaaacaaagaaacgtaaacaaaaaagtaaagaacaagacttgctgtgggagaacaacgtataaaaaaatgtatatgtattgaaggagagttatttatgattgtaccacgttattatgaggatttaagtgtattgcatgaaaacacaatgccagccagagcctattatattccggcatccaaacgaatggataacctggtggaacacagggaagaatcagaccgtatgcagttattaaacggaacttggaaatttcagtattataacagcatctatgatattcaggaatctttttttgagaaggattatgatacagaaaactttgacgagattcaggttccgagtgtatggcagatggcaggatatgacacacaccagtatacaaacatccggtatccgttcccattcgatccaccgtatgtaccgcaggatattccatgtggagcatatgcacatacctttatttatcacaaagatgaaaatgcaccaaaagccttcttgaattttgaaggcgtagacagttgtttttatgtatggatcaatggctcttatgtaggatacagccaggtttcccatatgaccagtgagtttgatattaccgaccttcttcaggatggagagaataccatagcagtattggtaatgaagtggtgtgacggttcttacttggaagatcaggacaaattccgtatgagtggaattttccgggatgtgtatattttgaaacgcccagagcaggcaatcagcgattatcatataaaaacaaagattgaggatatgcttgcaaaggtagaacttgatgtgaaattctactctccggcaaatgtaaaaatttcgattgaagataaaaatggagcagttgttgcagtaggaagtattaccgaagaaggaacagcggtgttagagattgcaagtccggaactttggaacacagaaaacccatacctgtacaaactgatccttgaaacagaaaatgaagtaattgtagatcatatcgcactcagaaaaatagagatcaaagatcaggttatttacttaaatggacagaagattaaattccgtggtgtcaatcgacatgattctgatccggttactggatttacaattagtgtggaacagattacaacagatcttacgctaatgaagcagcacaattttaacgctatccgttccagccattatccgaatgcaccatttttctatgaaatgtgtgacaagtatggatttatggtgatagatgaagcagatatagaggctcatggaccatttatgctctacagaaaagaagacacggattataatcgattcaagcggtggaatgaaaagattgccgatgatccggcatgggaagcagctattgttgaccgtgtgaaactcatggtagaacgtgataaaaaccgtttttgtattgttatgtggtcaatgggaaatgaaagtgcttatggttgcaactttgagaaagcactggcatggacaaagaaattcgatccagaccgtatcactcagtatgaaagtgcaagataccgtaattatgatgagacatatgattacagcaatctggatgtgtacagccgtatgtacccggcactttccgagattcaggaatatctggataaggacggaagtaagccatttcttttggtagagtattgccacagcatgggaaatggtcctggggattttgaagattacttccagatgatacaggataacgataaaatgtgcggcggctttgtctgggaatggtgtgaccatgcgattgctcatggcactgctgagaacggaaagacaatctatgcctacggaggagatcatggagaagatatccatgatggcaatttctgtatggatggattggtatatccagacaggactgtacacacaggacttttggaatacaagaatgtttaccgcccggcacgggttgtttcctatgatagagaaagcggagaactggtgcttcacaattatatggattttgatgatctggaggattatgtaaaaatcagctatgaactgacacaggatggactcgtgatcagtaaaggaaaacttgcagaagtttctgtggcaccacatagtgagggaaaaacaagcctgaatatcaaggttccggagaatggaaaatgttatttgaaactcatttaccagctgaaaaaagaaatgccattgttggagaaagaccatattcttggatttgatgaaattgaggtaagtaaagaggatacaaaatgtaaacttgcagagaaatggataccaaaaacagtagtggactctgaattacaggttaatgaaaatgatacacagattcatatcaaggggcgtgaatttgcttataccctagacaaacgtactgcactctttacagagatgaaattcgcagggcgggaatacttgaaccatccgatggaattaaatatctggagagctccaacagataacgatatgtacatcaagtctgaatggaagaaagcccactatgataaggcttacacaagagcctatacgacagaggttgtgcagggaaaacatggtgtgaagattacaagccatgcttccgttgtggcagagacagtacagaagattcttgatgtgacgattacatggaaaatagaagctgctggaaagattgatgcagatattgcagtaacaaaagacgatgaattcccggatcttccgagatttggtgtgaggatgttcctggataaaaaactttcagctgtaagatactttggaatgggaccacaggaaagttattgtgataaacatcaggctgcgagccacggtttgtaccgggcagatgtaggggatttacatgaggactatatccgtccacaggaaaatggaagccattatgattgtgaatatgtagagcttaacaacagccgatatggaattgtggtctctgcggaaaatgccttctcattcaatgcttcttattatacgcaggaagaacttgaggagaaaacgcataattatgaactgacagaatcagatagtgtagtattttgtgttgactatgcactaaatggcattggttctaacagttgtggtccagttgtattggagcagtaccgatttgatgatgtattattccggttccagtttacactgataccgtatataaagggataataaagtttcatgtaacccgtaaacaaggaaagagagtctgattgttatgtaaagtccggatatacagagcaatcagacaaaaacagagaaaaaactagaattagacatcatactctgttagacatcttgaaattctaagtgcgatgaagatgaggagcaaagaaattcgatggaagaaaaaaagtatttgaaatggtataacaaaattggatatggatcaggcgatattgcaggtaatgtagtctatgcgttcctgacatcttttatgatggtctatttgacggactcagtaggacttgctgcaggtgtcgtaggtaccctgattgccgtatcaaaactatttgatggttttacggatatattttttggatcaatgattgacaaaacacacagtaaaatgggaaaagcgaaaccctggatgctatatggatatattggttgtgccattacgctggtctgctgttttgcagtaccagtcagcttgggaacaacggctaaatatgcatggttctttatctcttacacactgttaaatggtgtgttttatacagcaaacaatattgcttattcagcacttacgtcactgattacaaagaacagcaaagagcgtgtgcagatgggatcttaccgttttatttttgcgttttcaacaagccttctgattcaggcaattacagttggatttgtagataaatgtggtggagatgctgcagcatggagaacggttgctattatctatgcaatcattggtcttgtcgtaaatacgatttcagcactttctgttaaggaacttcctgaggaagaacttaacgaaggagaagtaaaggatgataatgaaaagtacggaatggtacaggcattcaagcttcttgttaaaaacaaatattacatgatgatttgtggaacatatattttacagcagttatatagtgccatgattggagctggcatttattacatgacatgggtactgaaaaataagaatttgtttggacaatttgcatgggcagtaaatattccactgatcattgccctgattttcacaccgacattagttggtaagtggaaaggtatgtataaactgaacttaagaggttatgtcttagcagtcatcggtagagcacttgttgttgttgcaggatatatgggcagtgttccgctgatgatggcatttacagctcttgcagcattaggtcagggaccatggcagggagatatgaatgcagttatcgcatcctgctctgagtacacttatcttacacagagaaagagaattgacggaacgatgtactcttgtacttctcttggcgtaaaaatcggtggaggtattggaaccgctgttgttggatggctgcttgagttcagtggatatatcggaacaaatgcaactcagccgcagtctgcacttgatatgatgcagtttatgtatctttggcttccgttaatctttgatgtattgattatgtttgtactttcaagaatgaatgtagaagatgcaaataaaaaactgaaagcagaaaaaggaattgctgctgatgaagtaacagatgcatcagacataaattagaattgacaggagaaagcgttgtctggtcattgctcgatgagacagtgcttttttctatatataaagtgattgaactgtattttgaaaataaaaaaggaccacttcatttttgtgaaatggccttaagaaaatattcagttttcacaaaatagtccttttagtatttatgcatggtaaggatgctcaaaatattcagtgtagaatactaaaaggtcattcagatatttttttaggttgctcatttgcaattcctcctttccttatttacaagttgattataagataggtgtaaaaggattgcttgccaaatcgaaagaagatatagacaaatgttgcaaaggggagtatttcatgcagttaaaatatgttgacacaaaagaggagatcatagcaataaataggaagtcaaaacttattgaaccacatcttcataatgcactggagatcgtttgtgtaacaagtggagcattagaacttggtgtcggacaggaactataccatatggaaaaaggagatataggctttgtatttccagatgttattcatcactatcaggtactgacacccggtgtaaataaagcgacttatctgattgcatccccatttacgatagccaaatttgcagatatcatgcaatccatggctcctgaatatccaatcatcaaagcggaaaaggttgaaccggaggtatatagggttataaatgcaattttagagacagaacagtcggatattactgttgcacaggcatatcttcaaattgtgttggcacgctgcataggaaaattaaatttggtagaaaagagtaatgtggggagcaacgatcttatttaccagacagtttcctatatatcagcaaattttaagaagaagttttctctggaagagatggcaaaagatctgggggtgagcaaatatgttttatccagactcttttccaaaacattccatataaactttaatcaatatcttaacgatgcaaggctgaactatgcatgccatcgtttggaaaatacgagtgattctattacaaacatttgtctggatagtggatttgaaagtcagagaacatttaaccgagtatttaaagaaagatataaaatatcaccgagtgactaccggagtacatgtctgaaagatatgttgtcataacatatagattaataaactcaataaaaatctgattatcagtctgaaataagtatctctgggtgttatttataatatggggtagtggttaattattatgtcatgtatgaatggggaagaaacttaaaaaagacagctgtcggtttttgataccgatagctgtctgatttttcaaacctagtttacataatatatttttacgtaaactaaagttaaataagtggatttatttgagttataataaaaataaatactcaagattgcgaaacagcagaggtataaataacaaagagatatcgtaaagataaataatgttttagcaattttataaacttacttataaattcactacagactttttgcaaggaaaaaataacaacaatgcagcaggaggaagttaagcgatatggacaagagagaactcatagcacaaaatatttcacaattttgaatattctacggtaaacgcagagataaaaggcaaagtagaaagtatcttaaagccgaagagcggaacaataaaagcagattgcatcaacaaattgattttggaagaaaatagttataggacaaaaattatttgtccaggggtaatttgtcgattagaacacgcagagtagtactggataagcgagaaaagtttagcggacaaatacagatttaaccgctaaagtctggattttttatttttgatatgttaaactactcccaaacagttacttttaggaggttttttatggcaaaacaaatcacttatcgagaacaggaaaaaattcaaaatacaatgaaacttcgagaatttttatcggaacttccaccctacgcaaaggattattttcgtgcaaaagaaccgacgacatctgataaaacccgtttatcttatgcgtatgatttacgagttttctttcggtttcttcaagaaagtaatccgaacttaaaagaaaaacaaatttctgaaatttcactttctgatttatcggcacttcagccagttgattttgaagaatttgaagattatttaaaggtttatcagacaccagatggacgcacggaaacaaattcgcgtgtcggaattgcacgaaagctctcctgcctgcgtagtttttacgaatatctctgtaaacgtcagctattatctgagaatccagtacgcttgattgatatgccacgtttaaaggaaaaagccattattcagcttgatcctgatgaaattgcatcattactcgattatatggagaattatggaaatggattaacaggtgtacaactttatcactataataagcaaaagtatcgtgatattgcaattgttaccctgctgctcggtacaggcatccgtgtttccgagtgcgttggacttaatatttctgatgtagactttaaaaacaatggaattcgcgtgttaagaaaaggcggaaatgaaatggttgtctatttcggacttgaagtggaagctgcgttaaaagactacctggaactttccagaaacaagataacaccactttcaggtcatgaaaatgccctgtttttatccggtcagagaaagagaatcagcgtcgatgcgattgaaaaaatggtcaaaaagtactcttctgctatttcggtaaaaacaatcactccgcataaattaagaagcacctatggaactgcgttataccgcgaaacaggcgatatttacctggtggcggatgtattaggtcactcagatgtaaatactaccaaaaagcattatgcgcgcttgagcgatgacagacgtcgtgctgcttcaaaagcggttatcttacgagaaaaaccagattcacacaattcttaaaaagaaaagaaaggcggaaatatccatatatcgaaatatcgaacataagttcaaacagacatttttgcctttcttttttatttttcaatagcaaaataacacgagagaatgtcaaagaatgtttcagcaatattacttacccaagcgctacatccagaatcatcatgacactaaaaccaacagcaaaaaacaaagtaccgatattagagtgttttccctctgacatttctggaatcaactcttctactacaacataaagcattgcacctgctgcaaaacttaaaagataaggaagtgccggaacaatttgatttgccattaaaatcgtaaaaactgctccgattggttcaacaattccggaaagtacaccaccgacaaatgcttttgatcttttcatgccctctgcacgaagcggtaaagaaataattgcaccttctggaaaattttgaattgcaattccaagagacaatgccattgctccggcaactgtaatttcagaatgccccaacagatatcctgcgtaaaccacgccaactgccattccctctggaatattatggagagtaactgcaagaatcatcatggttgttttttgcagacggcttgcaggaccttctgctgtttcactgttttgatgcagatgcggaataatatgatctaacaataataggaataacgtgcctatccaaaagccaatagcagcaggtaaaaaagcccatctccccattgaatcagactgttcaatagcaggaattaacaaactccagatagaagcagccaccattactcctgctgcaaatccagttaaagcacgctgaacctgttcttttaaagttttcttcataaaaaagacacaggctgcgcctaaagaagttcccaaaaaaggaatcaagattccataaaacacgtgttcgttcataatgaaaaatcctcttttctttttatagattataatatgcgattagtcttaactaactacatattataacggacttcttttaatttgtctactatcctgttggaatagacagttatttttccttatgttataattcagagtagtaaaattattgttatatctaacttaaagacgatacgaaaggatttttttatgcctggttttatcttacatttaactgcagctcaaatactgttaaaaagacttccacatcatcctgattttccatacgaaatttcttcggtaaatgattttttgatcggaaatcttcttccagatacaacaaaaccaaaagatgcctctcacttccgtaactcagcttattatgaaaaaatgatggtatttccggatttaacacgttttctgcaaaaatatagttctctgcttgcaaatcccagtgtgcttggatactattttcatctttatattgaccgaaaatttttcaaagatttcattcctcaggtcgtagaattttatgacaaaaatggacagattacagatattcgagatgaggttgcgacagtttatattcaaaaatcgcaaacttctatcccattttccaagtatctcactgaagaatactattacggagattatacaaggatgaatacttatctggtcaatcaatataaaattccacttgatttaaatccagaagttgtaaatccaggaatttcagaaatttgttataaagatgtgcaggaggttctcttacaacttcatggctttctagctgtttcaccggaagctgtaagagaacttaaggtatttccacttgaaaaactgcttttggctttggaagagtatgttgaagagtttttatctgttccaaataaatatttgtgattagacgaaatatttcgtactattcttcatgctttatagtttcattttcgcccaaaatcttataagtttttaaaattttttcaaagtctctatcatgtttttcacgttcttcttttgtatattttgtttctccaatacaaattgctttaggtataccatgcttcaattcttcgctcattatatttctccataaagtataatatttgccattataaattcattaatcaagagataggtatttactttaataactccaaataacgaatggcttcatatacattatatacattagaaaaaattttacaaagtgtattgtatcttgattattttgggatttatatatttataagttaataaactcaataaaattctcaataaataaataatagtttccataacaatatattatggaaactaaaaagcaaaaactgtaaaagatgtaaaactatttcatgctcatgaacaggaataggaagaaaaatagatagaaagtcaaaaaagaacctccttgaataaggaggttctttttgcttcttatttattattcgtttttaatttacaatgtttgtttatcacaattcgtttaattaacgaaaactctttaaccagtttactaaagaatcatgccagatattctcagctacggttctcttcatatcttctgtaactggaccattgtttgccatttttccaagaatcgccgtctgtaactcttctactgtcatttcttctggtgttttatttgcaattacagccatactatcaacagcttctgcctgttccgctttcgtttcggattcggaagcatctgaattttctaaagtcaattctgaagtcaatgaggcagcaggaattgattcttctacagattcttttacatcttctgtttcggaagctttttcagctatatctgtaacatggtcaactggtttctcaattacctctgtttccttatttacttcttctattacaacttctttctctgtttcttgtttgctttcttttttagcttctttaggcagctctacttccggaagttttccttccatatccgccggaatccagatttctcctccatttgcaggaactgtaacatggatttgtccattttcaacagaaactttcttaccgcttaatgcgccaatatactgagctgtatttccggcagaaagagtcatctgtgcatcattgtcatcattattcacggttacaattacttttatatcatctaattctcttgcaaaagcaaattggcggtttgtcaactgtagttctgcatatccaccataacttaatgcaggagtctgctgtcttacttttccaagtgcggtaattaaggcagtgcaaggattttctttgactgcgtttttatagtcttctaactttaacgccggacgcaggctgtcatctgagaatttttctttctttccttctatagcaaattcagagccgtagtagatgctcggtatacctggtaatgtataaagaagaatatgcaccggtgccatatgtgccttattagaaagcttggtataaatacgttctacatcatgattatctacaaaattatataaatcaagttttcccatattcagcaggtattttacggtatgcgcaatttcaaaataattatggtcgttatgtccactgtaaagtgccttatgcagtgcatagtttgtaacactgtgcagagtatccccatttacccatcggctgtaatccccatgaatgacttcacccataagccagaagtcttctttcacttcttctgcggtacggcgcagagcgtgcatgaaatcaaaatcaagcacatctgctgcatccagacggattccatccacatcaaattcagatacccagaatcgaatgacatcgcagatataattctgaacttccggatttcgctgatttaattttacaagcagattgtaaccgccccagttttcataagaaaatccatcattgtattcattgtttccaccaaaattcacattgcaataccaatttaagtatctggaatgttctcgattctgctgaatatctttaaacgcaaaaaaatcacgtcctgtatgattaaagacaccatcaaagattactttaatctgattttcatggcatacttctacaaatttttttaaatcttcattggttccaagacgagaatccagttttttatagtccgttgtttcatatccatgtccaacactttcaaacaacggaccaatatataatgcagtacatcctatttcttttatatgggaaatccagggaattaaagtgttcagacgggaaacaggagttccataatcattttcttttggagcacccgttaatcccaatggataaatgtgataaaaaattgcctcgttataccagctcatagtacacacctctgtctttttatttgttggagtaaaaagttttaccccttaacatctttgtatataataacagattttttacttgttttccagattattttctatcatttcgccataaatttatattgttgtcttttctggagtgtggtaaaataattttcgtttacaaaaataattttcgtttacaaaagaataaaaacataaaactattttttgaatcaaagggggattctgattattatggaaagggatatgacaaaaggcagtcctttacttgttattttgaaatttacacttccgctgattatcggaaatatttttcaacagctttataatatggcagatacaattatcgttgggcattacgtcggagccaatgcacttgcagcggtaggttcaaccggaacaattatgttcttgattgtcggacttgcacagggaattactgctggttttactgttttgacttcccaacgttttggtgcgaaggatacgaatggcgtaaagcgaagtgtcgcaaatggaattttactttcacttatcagtacatttttattgacaactttcagcgtattgtcgatgcactggattttaacaaaaatgaatactccagcaaatatttttcaggatgcttatacgtatatcatgattatcagtggtggactgattactacgattttttataacctgctctcctcttatctgcgtgcggtaggaaacagtcagattccattagtatttctggttttttctgctgttttaaatgtaattttagacttgattttgattattaaatttagaatgggagttgccggtgctggttacgctacgattctttctcagggaatttcggctgttttgtgttttctttatatttaccgttatatgccggatttaactccacaaaaggagcactggaagttttatttggcggatacccgccatcagttatctgtcgggattccaatggcacttcagtttgcaattactgcatcaggtacgatgattatgcagtccgcaattaacctttttggttcagatgctgttgcttcctttacggcagcaggaaaactgcagaccctggttacacaagggatgatggcaatgggacagactatggcagcttatagtggtcagaactttggaaagggtgatattttacgaattaaaaaaggagtaaaatctgcccttcttgcttcaacggtttattccatcgtcgccgctgttttgatttgttctcttttaaaaccgtgtctgggacttttctttactggagatgtcgatattacagtaatgttgccttgggcaaagacttatgcttatatgtgcgcaattttctatatcccgctaagcacaatctttattttcagaaataccatgcaaggctgtggctacggtttcttgcctatgatgggaggcgtttcagaactgctggcacgtctgctggttgcaatgattgcaatgtctgtggcaagttatccgctttcctgcttctgtgaccctgctgcatgggtaactgcggcggtctttaccggagtttcttatctgtttgtcatgaaagatatcgataaaaaataccgacaggcatcgtaaactaacaaaaaacaaaacaggaactggaacagctatattaaaagattgaaagagctaatttcatcatatagaatcatataaataaaaagacttgttgtcagagcattttatggcagcaggtcttttggttttatgctataataagtaaaaaatgaaaaagaaagagagtgatttttatgtcttacataacagatagctacgcattaagcggtgaaaccttagtaaaacaatttaagaaacgaaacatggaagcgttttattgcgcaaccaaagaggaagccaaagaaaaaatcctttccatgattccaaatggctcttctgtcacctggggtggtacagaatctatggaagaagccggtgtatgtgaagccatccgtcagggagattatgaatttattgaccgaaaaaaagccaaaacaccagaagaatcccgtgcactgtatggtcagatagtctgtgcggattattttttaaccagttccaacgcttttacaaaagatggaattttagtcaatattgatggtgcgagcaaccgtgttgcctgcattgcgcatggaccggcacacgttattttcttaatcagcatggacaaattatgtgcaaatgttgatgaggcgattgaccgtattcacacacatgcctgtcctccaaatgcacttcgtgtaaaagcaaatacaccttgttctaagaccggtgtctgtgcagattgtttaagcccggactgtatttgttgtcaaactttaattacaagattttctcgcataccagaccgtattaaagtgatactttgcggagaaaaactgggattttaaatttttttgacccaatcaagtaatgaggcagattataaatatctattcaaaaagaccttctacgttctgaaaaaattgtagaaggtctttttgaatagatatttatttaattttaataaaatccacagccactttttccatactcttttatatagtaaagcgccttattctttttcactttgaaaggaaataaatccaaacaaagtggcgacaataattgtgattataatactccaagtacttactctttcgatttttattttccgtttcattttcactaaaaatctccatatttattttttatgtaattatactctcttcaagctatcttttcaatttcgttctacagaacaatatcgaaaattttatcaaagccattaatttttcttgtgtttttaaacagatagatttaaaatttttattttttgtgtgtggtgttggtttttgatgttatagatatatttcatactataacattgtgataacaaaaaaagaaccgaccgaatttattttttcacagccgactcttttcccctatttcttattttacacgaatctgatagctcttttcaaatatttctcctgctttgagttcatttccccattctctttcttctaatttcttagaaaaatcttctttatcacttctgccataccaaggttcaatgcatacaaatggcgcactcttctttgccggtgaccagattccaaataatggagcatcaaattctacttccagataagtctctccctgaggattcacaagccctactctctttgcctgatttccttcgataattaacgcatcttcatcaaataaatcttctactattctcattttatgattggttaattcaaattctttttttctggcagtaagcagtccggtctctcctaagatactgcatacaagagttttatctgtatcaaagctcaactgataatcactttgtttctcttctgcttttaatggacagttaaatgcaggatgtcctccaattgaaaaatacatcttcttctcatttggattttctactttccaaagcacctctacacttcgcccatccagacgataccctaaatgcagacgaaatgcaaacggatattttttcaaagtctcttcattttcttttaactcaaaccagatttcttcttctttttggctttctaaagtaaattccatatcccttgcaaatccatgttgggacatagaataagttttcccttcaaatacagactctttttctctgtaatttcctacaatcggaaataaaaccggtgaagttcttccccaatatgcagaatctccatgccataaatactcttgattcgttttattatcttttaaagatttcatctctgctcccttagaagaaatctttaatgttaattcctgattttttaactggtactctgccattttccttccccctctagtcttcaaacacctgtctgatgctgtcataatgcaggaaaattccctgttttgcataagccttgatttgttctactgtcgcaatttcaaatcccgccacttcttcgtcctgtacttttacatctttttcatcaaactccagcacaaacttataaatatctacaaaataattatttttttcttccggattaattcgctgataggtaaatacataaccgcctccggcatttgaaacatcgattcctgtttcttcttttacttcacgcatggcagcttcttttgattcttctccggcacggactccgccacctggcacctcccaccagcctgctgcccattccttatccatacgacgctttgtaattaaaaatttcccatccggtctttgaagcactccaagtacggtaagatgaaattcatccggtttcatattccagtcgttacgcttcattgttcttcccattttttcttttttttcattatagatatcccataattccattttactttctcctattttctcttattttgtaatttcttttgcaagttctgccagttttttactgctttctttaatattcggctttgcataaattcccgacacaaccgccactcctgcaacaccactaccctttaactgcagaatattctcttcacatacaccaccaatagcaacaaccggaattgaaacactctcacagatttcttttaatacctccatcgaaatcttatttgcatctcctttggttgttgttccaaagactgctccaacccctaagtaatctgctcccatttgttctgcttcttttgcctgttctacggttcgtgcagatacgccaatgattttatcagcccctaatctttttcttacctccatagctcttgcatctttttgtccgacatgaactccatctgcatcagatgcaagtgcaatctctacattatcattaataatcagcggtatctgatattctttagttaattttctgattacctttgcttcttctaaaaattcatcttcctttaaggacttttctcgaagctgaatacaggtcactccacctttcagggaatcttctatctgctcttcaaatgtcttatctcctacccaggcacggtctgtcactccataaagcagcaatgcctgttttactttttctcttttttcttctatcgtcacttttgctatacctttctttctatctctttatttttcctcattttgaccccattctatcatagattccaaaaaactgcaaaaccaaacgttttgtatttttttcagaacctgaatttatgtcgttgactttatttttatcttgtgctacaaataaactcgtaagttatatttctcttcttttatggaatactatggtaaaaatttctctttttacgatagaccattttacatttcaaagaagaaatcaatcatttttgattgtttctttcattacaagattccatttttattcttttaaattcgaatcttgatatagaatggtttcgttttgtatacaatatacaattttaccatatcttaccaattttagactttttactaccagactcaaaaagaacaggaggtacttatttactatgatgagacaagaatggagaacttttaatggcggagcatgggaaaaagaaattaatgtccgcaattttattcaaacgaactatatcccttacgacggaacttccgatttcttagaaggaccaaccaaagatactaccgatttatggaatgaagtacttgacttatataaacaagaacgagaaaatggcggtgttctcgatatggatacgaaaactatttctaccattacttctcataaggctggatatatcgacaaaagcaaagagaaaattgtcggtttacagactgatgtcccgttaaaacgttctctccaaccttatggtggaatccgtatggcaattaaagcgtgcgaagacaatggttatcatgttgaccctgaagtcgttgaatactttaccacgcacagaaagacgcacaatgcaggcgtatttgatgcctataccccggaaatgcgtgcctgccgttccaatcatattattacaggacttcctgatgcttatggacgtggacgcattatcggtgactatcgaagagctgctctttatggagtagaccgtttaatcgaagaaaaagaagaacaaaaagcaagcacccgtactattatgtattctgatgttatccgtgaacgagaagaactttccgagcagattcgtgctttacagatgttaaaagaactggctaaaatctatggctgtgatatctctgctccggcaacgaacctacttgaagcaacacaggcattatactttgcttaccttgctgccgtaaaagaacaaaatggggctgcaatgagtcttggacgtacctctaccttccttgatatttatacagaacgtgacttaaaagaaggtacatttacagaaaaagaaattcaggaaatcattgaccagtttattatgaaactgcgtctggtttgctttgcccgtactccggaatacaaccagttatttgccggtgacccgacctgggtaactgaatccattggtggtgtcggaattgatggccgtccactggtaaccaaaatgtccttccgttatttaaacactttaaataatttaggtgctgcaccagaaccgaatctgactgttttatggtctgttcagcttccagaaaactttaaaaaattctgtgctgatatttccatcaaacattctgccatccagtatgaaaatgatgacattatgcgtgttgttcatggcgatgattacggaattgcctgctgtgtttcttccatgaaaatcggaaaagaaatgcagttcttcggtgctcgtgcaaatcttgcaaaatgcctgctttacgcaatcaatggcggtgttgacgaaatttccaaaaaacaggttggaccaaaataccgcccaatcacttctaaatatttagatttcgatgaagtaatggataaatacaaggatatgatgaaatggcttgcaggtgtttacgttaatgcattaaacatcattcactacatgcatgacaaatacagctatgagcgtcttcagatggctctgcacgataaaaaaataagacgctggtttgcaactggtatcgcaggattttccgttgtagcggattctttatcagcaattaaatatgcaaaggtaaaaccaatccgcgatgaacaggggattactgtagactttgaagttgaaggagatttcccgaaatacggaaatgatgatgaccgtgttgatgcactcgcagaagaagtacttcacacctttatgcagtatatccgcggaaatcacacttaccgtggcggagttccgacaacttctattcttaccattacttccaacgtttcttatggtaaaaatacaggagcaactccagatggaagaaaagccggagaagcctttgctcccggtgcaaacccaatgcatggacgtgatactcacggagcaattgcttctcttgcctctgttgccaaaattccatttatggatgcgcaagatggaatttccaacaccttctctattgtgccggacgcacttggcaaacatggaaatgatactacaaacttagttggaatgttagatggttatatgacaaagggcggacatcacttaaatgttaatgtatttaaccgtgatactcttttggatgcccagaaacatccggaaaattatccacagcttaccatccgtgtatctggatatgctgtaaactttattaaattaacaaaagaacagcaggatgaagtaatttccagaacgttccacgaacgcatgtaattttgataaaaaaggagattaaacactatgaaaggtcggattcactcactagaaagttttggtacagtagatggaccagggattcgttatgttgtattttttcagggctgcccgatgcgctgcctctactgccacaatccagatacctggagtacagaagctggaactttaatggaaagcgatgaaattttaaacgccattaaaagaaatcagaccttttatacatctggaggtatcaccgctactggcggtgagcctctgatgcagatagaatttttaattgaacttttcacaaaagccaaagaaacgggaattcatacctgccttgacacttcaggaattttatttaaccgagaaaatcctaaaaaactggcacaatttgaccaactgctttctgttacggatttgattctattggatatcaaacatatcaatcctgatgagcataaaaaactgacttcacattctaacactaacatacttgattttgccagatatctcgatgagaagcagattcctgtctggatccgtcatgtggttgttcctgaaatcacttataaaaaaaattttttaataaaactgggagaatttctttcaacccttcataatgtaaaggccatagaagtacttccttatcataggatgggatgtgtgaaatatgagaatcttggttttgaatatgcattaaaagatgcaccccagcttacaaaagctgaggcgcaaagagcagaggaaattcttttagaaagtatcaaagcgcatacaggatgcgaatttatttctgattttggacggtaagtttaactcaaatatctgtgagataggtttttaaaaattcataaatctctgtttctgtagggggacatccttttaagtgacatgcaaattttgcggtacaatttccgattccaagcgttccgctttttcctcggaatccctgtccgattgcaatttttgtatctaactttttaagaagtccctcttcttttaaacggtctaatgccggcatcagatatccatagcaggcactgcaggattctacctcttctaccgcatctaaaagttctacaatttttctctttcttacttctaaaatcgccgcttctgttggtgtttgagttccacaactttttatcactgcatgttcaatatccgcactgccaactccaagtttttctgccattaaaatatatggcacttcttttatctcataattcaaaaaacgacacacataagcgtcacataaaacaggatctgttaccgccaaaattcgattcatcacaaccggatttccaccatcttcaaaatccaaatctccgcagatattatcgactacaataaaatcctgctgaagatacgcattcaagtgtgcaatcggctcatgcagacccattgtgtgaaaatgacgtttttccttatttggaattaacccctttaaattcttaagcgcacaggtcagcttcgtctgacagtgtccttttaagactggtacattaatcaaaaaatctaattttaaagctgtatcacaaatcagaagttccattcctttacaatcgcaaagagaactgctgtctttctgcatatctgcaagcggtacctgatatttttcagaaagtttctgatatccgcatacctcaaaagattcttctgttttatcaccaacccaggaaccctctaaaatcactaaattttgatatcctctctcctgaagatattcaatcattccctctaccacctcaggatgtgttgttccaccataagaggcctcactcggtgcgacaagattgggcttaattccgattttacaatttttattttctccattttttttcttgatttctgtttctaaatctgccgcttctaacaaatgcttggtattttctttatagtctgtaccctgtatcatccagatttcattttgattcattttgattccaactttctccacgttatttataatttaaaaaagaagccacaaaaaccttctttctggcttatcttaacaagccggactaaaaagttcaagtaacttcttctcatttactttttatgctgtctcttccgcaaaatttccggtataaagctgatagtattttcctttttcttccatcagctgttcatgtgtacctctctcaataattcgtccctgctccagtaccataatacaatctgagttccgtaccgtagaaagacggtgtgcaataacaaaagttgttcttcctttcatcagacggtccatcccctgctgcaccaatgtctctgttctagtatcaattgaagaggttgcttcatctaagattaataccggcgggtctgcaactgctgctcttgcaatcgctaaaagctgacgctgtccctgacttaagtttccgccatctccacttaactttgtctgatatccttctggtaatctgcgcacaaagctgtctgcattcgccagttttgctgccgcaatacactcttcatctgttgcatccaaacgaccataacgaatattatccataacggttccggtaaacaagtgagtatcctgaagcacgataccaagagaacgtcttaaatctgcttttttgattttattgatattaatgttatcgtatcggattttaccatcctgaatatcataaaaacggttaatcagatttgtaattgtcgtttttccggctccggtacttcctacaaacgcaattttctgtccaggcgttgcaaataatttcacattatgaagtacaatcttttcttcattatatccaaaatcgacatcattaaaggtaacatcaccttcgagtttggtatatgttaccgttccgtctgcctgatgtggatgtttccatgcccagacgcccgttctttcttttgtctcttctaatgttccgtcctcatgttcttttgcattgacaagctctacatatccatcatccacttccggctcggcatctaataagtgaaagatacggtctgcaccagccattgccataacaatactgttcatctgctgactgatttgagtgactggctgggtaaagcttttattcaatgttaaaaaagaaaccagagtaccaaggctgagtccgcaaattccactgattgccagaattgcaccaaatgcagaacataagacataactgataataccaagattattattaatcggcatcataatattggcaaaggtattcgcgttatctgcgctctttctgagttcttcatttaatttttgaaactcttcgattgctttttcttcatggcagaatacttttacgactttctgtccatccatcatttcctcgatgtagccatttaccttaccaaggttcatctgctgttccccaaagtattttccggatttttccgccagttttttcgatacaactgtcatcacacctaccattaagagcgtcagaattgtaagcgggatatcgagtacaatcatactgataaaagtcattacaatcgtaaccgccgagtttaatacctgtggaatactttgtcccataagctgtcttaaggtatctacgtcattggtataaacagacatgatatctccatgtgcatgggtatcaaagtatttaatcggtaatgattccatgtgtgtaaacaattcaacacgaagatttctcatcgttccctgactaatatataccatgattttattatatgctaaagaagaaataactccaacagcaaaaattccagccagtttggtaagcgcctgcatcagaggaacaaaatctggtgtttctgcttttgtcatcggtacaatataatcatcaatcaaagactgcataaataaacttccctctaaggttgcaaatgcagtaatcataatacatatcacgaccagaagaaactgaaacttataatttttcagcatatatccaagcgttctttttaatgtttttgtcggattcggcgcaccgttttttccaaatggtccacctgccactcctggaccgcctctcattactcttgcctgtcctgccattattttgcacctcctgtctggtcaaaatctcctccaccttttacctgcgtattataaatttcctgataaatctcattggtttttaacagattttcatgtgtatcaaatccattaatctttccgtcatccaatactaaaatacggtctgcatcctgcacacttgaaattctctgcgcaataataatttttgtcgtatctggaattttctttgcaaagacggaacgaattttcgcatctgttgcagtatcaacggcactggtagaatcatctaaaatcaaaatcttcggtttctttaataatgctcttgcaatacaaagtctctgtttctgaccaccggatacattacttccaccctgttcaatatacgtctcatatttatttggaaaacgctcaataaattcatctgcacatgcatttttacatgcttcaatacattcttcttttgtcgcagtttcatttccccaacgcagattttctaaaatcgtaccggaaaacagcacatttttttgtaatacaactgatacctgatttcttaatacttccaaatcatattcgcgtacatcttttccaccgacacatacagaacctgcatttacatcataaagacggctgattaaatttaccagacttgattttccacatcccgttcctccaataataccaaccgtttctccggaatgaatatgtaaatcaatgtcaattaacgtatctttttctgcttcatcattataagtaaattccacatgattaaaatcaatacttccatttttcacttccatgattggatttttgggattaaccaaatccgctttatcatttaatacttctgcaattcgttttccacttgcaatactaagtgttgtcataacaaaaatcatggacagcatcataagggccattaaaattgacatgatgtaactaaacatagaagtcagttcccctgttgtcatatttccaactacaatgaattttgctccaaaccaggataaacagatgatgcaaaaatagaccaccagcatcataaccggaccattaaaggctaaaatcccctctgcttttacaaacagtttatagacattttcggccgctgtgataaattttttattttcatagtcttctcttacaaacgcttttactacacggatggcagaaacattttcctggacactggcatttaacgcatcatattttttaaataccatatcaaagattttcattgttgtctttaccactacaataatgaaagctcccagtaccacaatcgcaattacaaaaatcagacttaattttgcattaatcacaaaacacataatcatactgcaaatcagcgtaaatggtgctctcaccgcaattcgtaatatcatctggtaagcattttgtacattggttacgtcggtagtcatacgggtaaccaaaccggctgtactatatttatcaatattagagaaagaaaatgtctgtatattttcatacatagcgtccctcaaattacaagccagccccgaagatgcatttgccgcatattttcctgcaagcacaccaaacaacaaactaaacatggcaaataccaacatgatacttccatatagtccaacttttttcatatttccagcctcaataccctggtcaataatcatcgcagtaataaaaggaattaatacttccattactacttcaagtgctgcaaacaaaggcgtcaacagtgatgattttttatactgtttcacctgtgccaataaagttttcagcatttttttacctcctaacacacgaatttattttataagcctttatatttttacatattttctctagaaagtaaatttaatttttgttattattaattaaaaaattttattaatatttcagaaaggatttttattattatgaatactatgcagctcgaatgttttctcgcagtcgctgataacttaagttttgcaagagcagcggaacagcttcatgtaactcaaccggcaattacccatcaaatcaattctcttgaaaatgaattgcaagcaaaactagtccgaagaactacccgtattgtagaactgactccagatggtagaacttttctgggttatgccaaaaatattttaaaagcaacacactttgccaaaaaacgtttatctgaacatcaccaggattacatccagactttttctatcggatgtcataacccatccgaattaaacttaatttctccggttttaaaacagctttatcaaacgtttccgatgctacatcctgatttgcgcatgattccctttcctgccctcagaaatatggtcgaagaagaagcgattgatgtcatgataggatttcgagatgaaaaaatcaaccttgcttctgtcacttatgttgaacttgcccagtgcggaatcacctgtgccctgtcaaaagaacatcccctcgcagatagaaaacaactcacgttaaaagatttaaatgaagaaccaattgtcttatgtgaaccggatcgctgtgcagaagcgattgctcagcttcaaggtcatcttcttgcttctcattctcactctccttcccagatttattttggagaaaatttagaatgtactttaactcttacaaaagcaggaatcggactcgccctgctgccaaatcttccattcatgcaccaggaagggctgacttatgttcctcttgaaaatgaaagtattatctcttttggactttatcataaaacgtcttttaattcaccgatcctaaaaactttcattcagattttaaaaaaactttgtcaacctttttgaaataaaagccaggacaagataatctcattgttaccctgtcctggtttttatcattcacaaaattaataataaagaaatgcaggcacacatcaaatgatatatacctgcatttctgcttttatctttaattttctgctttcttctatttaccgtctctctgttttaaatatgcagctctgccctcttcataaaggttattcccctcactgtcaatgattacaacaagaggcatatcctccacatataactttctgagtgcctctgctcctaaatcttcatatgcaattaattctgcttttttaatacattttgcaagaagtgcgcctgcacctccgattgctccaaaataaacaccatgatattttttcatcgcatcaattacttctggaagacgtgcaccttttccaatcattcctcttgcgccgacagacatcatagttggtgcgtaagcatccattcgaccactggtggttggtccggctgaaccaattacctgtcccggtttagccggtgtcggtcctacataataaatcgttgcatctttcgggtcaaatggaattttctctccttttgccagtgcctcacacattctcttatgtcctgcatctcttgatgtataaattgttcctgtcacaagcacacggtctccgctgtgaagtgttttagccagttcctctgtaagaggcagcgtgatttttctttccatcttaaattacctccgttttatgacgcgttacatgacagttaatattaatcgcacacggcatacctgcaatatgagtcggcattgtctcaatgttcaagccaattgctgttgtctttccaccaaacccctgcggtccaattcccagttcattgattttttcaagcatctcatcttcaagctctgcataaaacgggtctggattagaagaatccaatggacgcattaatgctttttttgctaataaagctgctttatcaaaagttcctccaattccaactccaacgaccataggcggacatggatttggaccggctgtctctactgtctcaataataaaatccttaattccctggagtccgtgagacggtttaaacatacggatagcactcatattttcacttccaaatccctttggacctactgtaattttaatctgttctcccggaacaatttctgtataaatcatagcaggagtattgtctcctgtatttccacgacgaacagggtctttaacaaccgactttctcaaataacctttgtcataacctcggcgaactccctcatttaccgcatcactcaagtctccgcctactatatgtacatcctgaccaatctctaaaaaaacacatgccataccggtatcctgacaaattggtacacattcattatctgcaatttcgaaattttcaataatattatctaaaacaccttttgcaatctctccatcttcacaggcacgacaatttttaattgcacactttacgtcttccggaagatgttcatttgcctcaatacaaagtttttcgattacgtcggtaatctggcttacattgatttctcgcattttaccactcctactctgttttcttcttatctctcatgacgtgcataatgtggaagcaataacggagatacatcatctgatgtaatgcctgcttctttcaattcttctgcatatttttccacatgttctaaagtcatggttccaagctctacggtttttgattttgcagcagctgcttttcctgcatttcttccaaatacaatgatatcaagcagggaatttcccatcaggcggtttcttccatggattcccccaactgcttctcccgcaactaaaagattgtcaattacctttgtaaatccatctccgccaatttcaagtccgccattttgataatgcagggtcggataaaccagaattggcagttttctcatatcaatgccataatttaagtacatacgaagcattgcaggaattcgtttttcaattgttccttctcctccaagtttttcaatcattggagtatccagccatacaccgcttccaagaggagtcgttacaccttttttacgttctgtacattcacgaataatagaagcagcagatacatcacgggtttccagtggatgcataaacgcttctccatctacatttacaagcattgctcccagagaacgtactttttctgttaccagtgctccataaatctgagccggataggcaactcctgtcggatgatactgaatcgtatcctgataaagaagtggtgctcctgcacgatagcctaaaatcaaaccatctgcagttgctccataatggtttgaagttgggaaattctgataatgcagacgacctgctcctccagttgcaatcacaactgtttttgcttttgcaaccagataatcacctgtttccatatttaaaagaacagctcctgcaatctgtcctttttcatctttaatcaactcaaccgctgaagtaaattcaacaacaggaatctgacgatttaatacttcgtcacgaagcgttctcatgatttctgcaccggaataatccttgcaggcatgcattctctttctggatgttccaccaccatgggttgtcaccatatttccttcggcatctttatcgaacattactcctaaatcattcaaccagtgaattgcatccggagcttccataacaagacgtcttaacagttccggtcttgcagcaaaatgtccgcctccaaatgcatctaaatagtgctgtaccggtgaatcattttctttatctgctgcctgaattcccccttctgccatcatggtatttgcatccccgatacgcagtttggtaacgatcataacctcagcgccagcttcatgtgcttcaattgctgcggaagcaccggcaccgcctcctccgattacaaggacatccacatcataatctactttattcaaatctactttatcggttaaaagacgactatttgaatgtaataagtgtactaactctttatttgctttctgacctttatttggtccaattttaatttcttcaaatgcttcttctcgataatccggatgaaaagcttttaaaagggcatctttttcctctgcactcatacgtctaggttccattcccatacgttcttctctggttgcctccacctttttcacggattccatcatttctggtgtaaacatggcttttcctcctatttctcgatttctctgttattataaagttcctgcatctcggtaattggtttctgcataatctgttcaatcaactcatcataagcacctttatgaatttcttctacacgtttctctaagtgcttgctctccggtgcaatatactttccggttaaacgtcttgctaaaaccccaaccattggatgagaaataccggccggacatcttaccgtacaacatccacatccgacacagtcaaaggattcttctgcacacttttctaattcgcctctctgagcataagcaatgtactgcatgacatttaaatcctgcgtacaggctttggtacaggcattacatccaatacaactgtaaatttccggatataattccatcataatctgctgatttggtttaatttcctgaatatcataggttcttttatctgtcgggaagaaaggaatacttgctacatacatgccctcttctacctgtgtctgacaggcaagacaggtttttaattcatttttgcctttaattctataaatcgttgcacaggctccacagaatccatgacgacatccgcagcctctttttaatgtgtatccggcatattccattgcggtcataattgtcaaatctgcaggcacactatatttctttccgaaaaaatatacatttaccatattttccatttgtgggtaccaatcctttcttaatactcattcggtaattcatcaatttcatcaaaacggaataccggtccatccttgcagacatattttgaaccgatattacagcgtccacattttccgattccgcatttcatacgaagttccaatgttgtataaacctgttcttttgtaaatccaagttcctgaagcccagaaagtacaaatttaatcataattggcggtccacaaactaatgcaactttatttgtgtcaaatccgatttcctttaaataggtaggaacaaaaccaacatgtccgtcccatccctcttgttctctgtcaattgtcagataaacattgacatcttttgctttcatccagacttcctgaatttcttttaattgaaccaaatcatctgcggaacgggaaccatataaaatatcaacggttccataattttcacgattatctaatacataattaataacagaacgaagcggtgcaagtccaataccacctgctataaacagtaaattttttccttttagctctgtctcaaccggaaaatgatttccataaggtccacgtactgtaatttcatctcctacttgaagactatggagatactctgtcaacattccgcaacgtttaatactaaattcttgatattctttattcgtcggtgaagaagtaatggagaacataccctcactcacccctggagcacaaaccatcgcacactgtcccggcatatgctcaaataattttccaccttctggcgcattgacgcgaaatgtctttacatccggagtttcttcacgaatatctgtaatgacaccaacttttggaattaaggtatctaatgtataatttttatgacagatacattcgctcattccttgtcacctccctgtttttcaaatgccttaattacttttacgatatttaaagaagaaggacatttttctacacaacgtccacatccaacgcaggaatacattccattattatttgccggatagtaaaccagtttatgcataaatctctgacggaaccgttgcagctggctggtacggttgtttccgtgtgccatcatcgtaaaatccgaatacatacaggaatcccagcagcgataacgctggacaccatgacctgtatcgtaatccttaatatcataacactgacatgttggacatacgaaagtacaggttccacatgccagacatggtttatataatgtttcccaaatcggagaatcaaatctttcttctaaagctcccccattccatccttctaatgataaatttgaatatggaagtttttctacaattttatgaattgctgttttttctgcttctatcttctcatcttctgctttaggactttctattaagcattcttttacaagttctgttaaggcttcccctttttcagtcaacgctttccagtataattcttcttctatcatccaaaccgctacatctgcatccgggctcgcacaatcaatcccaaaagccttacaaaaacaagactcttctggttcatgacaggccattgcgacaatagttccatgctctcttcttgcagagtaaaatgtatctaccggctcacttaagaatacattgtctaatacctttactccctgtacatcacaagctttcatgccaaatacaacaaatttctgttcttttaatgcttctggctcaatggaaagtttctttccttctttttgtactgtatacaaattttcactctgtggaaaaaaagcatcttttggagacttcacggtctttaatgtgtctaaatccacttctgcatctttatcccaggctgcaaaatttacctgattgctgacttttaccggaagatataactcctgttcttcggcaatacgctggaataatgccggaagatttttctttgctatctgatacatacattatcccctttccgttacaatacttggttctgcatcttcaaatgtaaagtttgtaagaggtcctcttgattccgcatcctctcctgcctgatattctccatataattcatcaatatctttaataaatttacggttgaataaatgcagaggaatcccctgtgggcatacacggctgcattctccacaatctgtacatcttcctgccacatggaatgcgcggataatatgaaacatcttttcttcaaaagaatccacattcgctttttgagcactgtcaaattttgtactgtcaaacacacatttacgacaactgcaggccggacatacgtttctgcaggcattacaacggatgcatttacttaactccccttggaaaaaggcaaatttctcttccggactcattgcttcgattttttctacttctgcaaaacgctctgcatctttcgtttctttcgactctccaatgatttcatcataaattttatgttcttttcccttacagacatggcatctttctaacattgcactctgataagtacaggtcttttctccataaatggtctgaattttcaacacttccgcttcatctgtaagctctgcccctgaaatagcctcaatgcctttgatattctgatttttaatcttttcaatatccagtttgcctttacaaccaacgccaacaatataagctttttctctgtttacacgatgttctttgatgagctgattaaagctgtatgtatcacacggttttaaacagaccatagtttttccttctaatttagaagcttctatcatatatttgcttaaatttgcgccacagaatccattataaacaaaatcctttaaagattctacagtttcaaaataagccggttccggattataaggcaagtctccggctttccagccaagtacacgcgctacggtcttatccgcaagcagttcttttgcacggtcaattatttcctgcatcttaaatcctccaatcgtacattttttccaagagaatgaatcttctcaacaaactcattcattgttgttgaaaacttcacgccctccgctgccgatacccattctacgcgggtacgtccattttccactccaatataatcaagcatggaaaacagaagtgtcatacgtcttcttgcataataatttcctgtactgtaatgacaatcccctggatgacatccacataaaatcacaccatctgcacctttttcaaatgcccttaaaataaacatcggattgacacgacaggaacaaggcacgcgaataattttgacatctgctggatagctaagacgactgcttcctgctaaatctgcacctgcataactacaccagttacagcagaacgctacaatcttcggtgtaaactcttcttttgcttctatcgacatattgcatctacctccgctataatctgtctgtttgaaaatccctgtaagtccattgccccggatggacacgctactgtacaagctccacatccctgacacagtgcactgttcacctgtgcaagacgacgcacttcacgaataccatggtcattgacttctttttcttcataagtgattgctccataaggacatacatttgcacacgtagaacaaccattacataaaagttcatctggttttgcggtacatgggtttgtcatcagcttatcttttgctaagagtccaattgcttttaccgcagctgctcctgcctgtgcaaccgtctccggaatatcttttggtccctggcataccccggagaggaagattcctgcggtcggagactctaccggacgcaattttgcatgtgcctctgtaaggaagttattcgtatcaatacttgcagtcaacatcgttgcaatctttcttacatctttgtttggttcaatcgcagcggcaagcactaccatatctgcttctttcaaaatttgtttattatctaataaatctgatccctgtaccaataattttccatttggctgtggaataacctttccaacctgacctttaatataattgacaccgtactgttctaccgctcttcgataaaattcatcaaaattcttccccggtgtacgcacatcaatataaaaaaccgttacattcacatccggatacttatcacgaatcagcattgcatgttttgccgtgtacatacagcaaatcttagaacaatagctctttcctctgttatccgcacaacgacttcccacgcactggatgaataccatttcttttggtgcttttccatcagaaagacgctctaaatgaccacttgtcggtcctgctgcattcataatacgttctaattccaaagatgtaataacatctttactctggctgtaagcatattcatcgtaattatctaatttaatcacatcaaaaccagttgcgacaacaattgcgccgtatttttgtgttacaatttcatctttctggtcataatcaattgcccctgcctgacatacctttgaacaaactccacattttccggttttaaacttaatacagttttcacggtcaatgaccggaacatttggaattgcctgagcaaacggggtataaattgcacttcttgtatttaagccacggttaaattcgctcggtgcttttttcgatggacatttttcctgacacactccgcatccggtacatttatccatatttacacttctggctttctttttaatatctactgtaaaatctcctacaaacccggatactttttcaacctcactgtaggtataaatatgtattttttcatgtgccgctgcttccaccatctttggtgttaaaatacaagcagaacagtctaaagtcgggaatgtcttatcaagctgtgacattcttccaccaatacttggctccttttctacgatatcaacctcatatccagcatctgcaatatccagtgctgtctgaattcctgcgattcctccaccgatcacaagcgctcgttttgttacacggctctctcctgggtataacggagtgtttaaattaacttttgcaactgccgcacgcattaaaataacggctttttttgttgcctcttccatgtctttatgaatccaggaacaatgttcacgaatatttgcaatctccaccatgtatgggttcaatccggcacgctctgctgcttttctaaacgttgcctcatgcatacgtggagaacaggaacagacaaccattcctgtcagtcctttttctttgattgcttttgcaatcaagacctggcctgcttcagaacacatatactgataatcttctgcatgaaccacacctggctccataagagccatctctgcaactttcttgacatctaccgttgcggctatgtttgttccgcaatgacagacaaatactcctattctctgcaccagggttacctcctatatcttctgaatgcactcactaataactgctgtggaagttccggatctaataattccggaatttcatctgctgacaaatacgcctgtcctctttgtctgactaccagctgtcttgctgcatcaatgattctacctggctgtacatctcttggacagcgttctacacaggcaaaacaggaaagacatttccataacgactttgactgaaccaacgcatcaatattttcattaatcacataagatacaaactgatgcggtttaatatccatttcatcaaatgctggacaggatgcagaacattttccgcatttcatacattttaaaggattggctccgctgatttcttttatcttttctgcctgttttttattatcattcatttcctgccacctccctcttggcttcttcttttacgccaagtgcttctgctaaaagctctgtaaaataataaaccggaagtgtctgatttccatttttctttaaattataaaggcaaagtggacaggctgtaattaacatttctgctccaaacccttttgcactgtctgtcactttttttgacatattttctgccatctctttttcttttaaggaaatatatcctccacaacattcgtttcggtatggatagataaccggctcagctccgattgcccgaataaaatcttctattacacttggattttccggattatcgaacgccataatctttccggggcgaagtagtaaacatccgtaataagcaccgattttctttccttttaacggatttaccactttttcttttaatgtatcaaatcctactctgtcacgaagcacctctaaaaaatgaagcacggttgtctctcctgcataaggttcttctaactgcatatagttatttgcccttgtccgaatatcctctacattcttcatatcatcattgacacgtttaatcacatgatgacaagcagaacaaagagttaccaaatcctgacccttttcttttgcctcattgagtgcacgtacggaagaaagttttgtggcaatttcatctgtaccgagcgggtaaaccccgccacagcactgccagttttcaatttcttccagttcaaatccaagcacttttgctgaagctctggcataagcatccaaatcttttgcctttgttctcagcgtacaccctggataataactgtatttcatatcctgttgtcctttctttttttactcttaaatattacatctggattttaatccagattaatctgtgcaataacctctttcaaggcatctgcactcttctttaactgttcaatttctttctgattcattcgcatcggtacttttccctgaattccattcggtccaactaaagtcaaagtacttaaacatacatcttcaattccatactctccatgcatcatagaggatactgtcgcaacagaatcagaagatgccagtacaattccgcataatttgcaaactgcttttgaaaccgcatagaaagtagcacctttatttgcaataatctgtccaccggatttttgtacataagcaagcattgcttctttatccagctcttttacatcttttccaagactctttgccagctcataatactcattgatgctcacaccggaaatataagcccctgtccaaggaatgaaagaagtatctccatgctctccaaatacataagcatgaatatttttctgtgatactttaaagtgttccgataagccacagcgaagtcgggcagtatctaagattgttccggaaccgataatctgattttccggcagtcctgaaatctttgtaaagacataagtcataatatcaaccggattacttacgatgatataaagtgcatccggtgctgcttttacaatctgcggtgcaatgcttttcataatattgacgttggtctgagtcaattcaattcttgtctgaccaggttttcgtgcaatacctgaagtgataattacaatatcagaaccttttgcatcttcatattctccggctacaattgaaatcgggtcacggaaacaagttccctgtgcaatatccatgacttcaccctctaccttttgtttgttgatatcaatcaaaacaatattggaagcgatgtcctcatttgataacgtataagcaatggttgctcctacactgcctgcacctataatagtaattttactgctcatgtttactcctttccccttagataagggcgctcttattgtcttttttttaacaatcgttttttaaaaaaatggaaaatcgtttttcttctcatgtagatttctcccaaaaagcacacgatatccgcacacaaaatggcattttaacgactttcgctctgcgctacctctgtaggatatcatatcgacaagaatttaacaacaattttttaacgattttgatatatttttttcttatggtgctttcgcgtgttattactgtcaagtggatattcgcaatccgcttcgctacttgctcataaccaaatagttgctacgcagcttatcagaaggggcttgccccctcctgatacaagcaagtccccccctgcttattgcttttcgcaattgaagcaggggacttacttgatttggttaaattattattctctctgaaaattgcaaaaaataccgctatccagctaactttgaaaggttctctcatttttctggtataacggtactttttttaatccactaatttatttaattctttcacgtattctgtttcatttgaatttttatgatttgcctgcgctgcatatttcttcactgcattctgagatttcttaatcgactgcatcgtacccgcacctgcgatacaaccaccagggcatcccatgccctctaacagataaccattgtattttccggcttttgccatcataagcagttttcgacagtctcttaaaccctccgcatttgctattttaatctctctttctggatatctctcctgaatcacatttaccacagactgagcaactcctccggaaacagcaaaatttcttccatcctcagatgcatcattgattccttcaacttcttctgttaaagatgccacatcaatatcctttgcttcaaagatacccatcatttcctcaaaagtcaatacaaaatcaacttcactgcgaactgattttctcattgcctctagttttttggcagcacacggtccaataaatacaacctttgcatttttatgctgttctttaatcagccttgctgtaagcgtcattggagtcaatgccatagaaatacactctctgtattccggatacaatttttttgccatagaagaccatgccggacaacaggaggttgccataaacggcagtttatttggaacttcctgtacaaaatcttcagcttcctgtgtcgcacataaatccgctccaatcgccacttcaaaaatatccgcaaacccaagcattttcattgccgaacgcagttttcccggtgttacttttgcaccaaactgccccacaaaggcaggtgcaagtgccgcatatacacgttctcctgactgcattgcacgaatcacctgaaagatttgggatttatcagaaattgctccaaatggacaatttaccaggcactgaccacaggaaacacatttttcagaatcaatctccgcttttccattttcatctgaaccaattgcatccattccacaggctttggcacaaggacgttcctgaacaataattgcattataagaacagacctccgcacattttccgcacttaatacatttttcagtatcaatgacagaacgtccatttgtccgatctaatgtaaccgctttcttcggacagacctctacacacggatgagccaaacatccctgacacccctctgtcacataaactcttttctcagcgcatgcattacatgcaaatttaataatattaatcagcgggggagtatagtacgtttctgcctgatctgccagtgcaatgttgtccgataacggtgcatgttctgctgcactcctgcatggaagtcccattgcaagtctcaaacgttcccctacaatcgcacgctccaggaacacgtcatttctgaaatttcctacttctccgggaataatttcgtatggcaattcttctattttagccgcaacactattttctgtatcataagccatacgtgccacttctctgaaaatcattcttctgatttcttgaattctggtttctacacctctcaataaatccttcctcctgttttttattccctctttgcctccattttaactactctgcttttatttttcaagtcttttatctgttgtatttttttttatacgaaatgcttatctgcggtaaagtaattttccaatctctccaaatttaaatccgaatgttcaatttccctggcataacgataagccagttccactttatcttcaaatgtaagcgttttcttttctgatatccactgatacatccatagttccgtaatccattctactgaaaataaactcagtgccattttactccatattgcatcatcatagactgctccgcaaaaataagtatacacaaaaaacatcataagctgttctttttggatttcccattcttgttttttatcactctttgctccgacacccttctgaaattcttcataaatcctacagtagttctcttctccgtcctgatagagcagttctgccagattttccaatgtcacgctccatgcactctccaaatgttccaattcctcctgtaacactcgaatttctcttttcatacgcgcataccgcgcatggggcgcttctattttatactttttacaaagtagctttatatcctgatttcgatactgctcaagcagagcatcaatttcaaaaaactgattttcatcaactgcttcctgcatcgcttttgccagttctgcacacatccatgctcttttctcaaagtttaagtcacgattttgtataatcgtatacaaaatatctctcgcatcttcaagttgagtaaacatcaaaaaatcaaatgattcaaattcttcctcttcttctgtctcccactccgaaaatgttactttcttttgattttcaagtatcatttctgccgctttgggacaagataaagaaagagaatattcccgcagtccttcatattcttccacatgacgcggatacattttacaggtatcacaaagataactctctccaagctctttttgaatctcacacaaatcttcttcatttaaaaaggcgcaacgactcccatactgaaaaaaaatttcttcttcccaatcaattgaattgcgaatccgattcccaaatggtccggaaagtccttcatatttatcaagagatgtttcgtcaatcacaatctgccatcccgcacagcaggttttcggacaagctccggcaagacaggaaaattcatcataaaaatccggttttaaatatctcatcgtttcttctccttattgtctgtccaatgtataaatcagtttcttcatctgtgtcatccgctcatcaaactgtttataaaaatcgctttctaaatcaaaagccgtagtataaaaacgattcaaaagatacatgctcaactcttgattcagccgggcatccgaaaggcgtaacaacagcgcttttgtatctttcagaaaataatgccactcatttacaaagttctcatactgtttcaaatcaggaatccccagccatttatttacctttacttttgtacgatttgctttggtacattcctgtgactgcaggtaataagaaaaagaaccgtcctcataaattctgccaagcggaaacaaacgacaaaaaccagggcgaaaagcatgaatggtacatcttccctcttcatttaaaaaggcgcatccatcctcttttccctgcatttttaaatttggcagaatcaatccctcttctgcatgaagagaaatcttatgattcaacagttcttcaaatttaacacctaaatgtttgttcatctgataaatatcataaggatctaatactatcgaatctcccatcccgcaacagcaatcgtggcagcctttacagccgccacaatctgcttttaccatatcggatgaactatataatttttttaaatcttccaacaaaacttctcgttccattattttctattctcctcattcttaacctgtacgcttgtaatcactctatatctgattttcaagcctgcatttgcccattttctcttaagttcattttcttaagtatagatggaaaaagaacacttgtaaagaaagagaacaaaaaaatgtaaagcggacattcgcaatccgcttcgctacttgctcatgaacgcagtcgctttgcgatctgtcagtggaagctttcacctcacactgacagaagcatccccctcacccgctgcttagtgctccgcgcacttgaagcagggaaatgcttatctgcgttcaagaaaccacctgcagtttttttctgcttttttgtaaaaacaaaaagagaaatgctacacctgctgcaatccaggacgcaatataaatccagatgatacattccattgtttcaaatgcaggaagtacaaaccagattccgcatacacgaagcaaacagatactgacaagcgtcgtaatcataggagacagggtttctccgagtccacagcacgctcctgacagtgcctctgcaaccgcataaaagaaataaaacggagccatcattctcatataccgaacgactaacggaattaattcaacggcatcttttttgtcaataaaccacggtccaattaaccccgatgcagtaaacaaaatcacacttaaaaatccaactgcgatgatagaaattccagttccgataaaagcacctttttttactctttcatacttacctgccccaagattctgcgccacataagtcgtcatcgccggtcccattgaatctgccaccaaccagattagcatactcaatttgtcacagatactccaggccgcaatactgtccgttcccatcgtatttacactcgcctgtacaatcgagtttgcaacgggaaacagcatggactgaagtgcaagtggaaaaccaatttttatcatcatggacatatgttctgcacaaaaatgcagatgccatacatgaatctgtcctccggcatgctccaagcgtgccaataatttaaacgtaatgattacgcttacaatctgtgcaaaaatcgttgcaattgccgctccggcaactcccattccaaatacaccaactaagagaaaatctccgacaacattaatcaggctgctcaaaatcaatacatatagtggtcgtttggaatctccaaacgctcttaaaattcctgctgccatattataaagaattaaagaccataagcctccaaaataaattcggcaataagttaaagttgctccatgaatgtctgccggcacacgcatcactttcaaaaaccatggagataacaggacacctgcaatagaactaatgactccaagcaccattgcaactgtaagcgccgtacgaatggaacaatgcagattttctttatcctttgctcctacatattttgaaataataatcgttgccccagatgccagtccattcataaagttaatcggaaacttaaacaatgtatttacagaatcaattgctgccagacccactttgccggcaaatcttcctacaataattgcatccacggtaatataaagctgttgaattaaactgcccgcaatcaatggcagtacaaataagagaatcgcctttccgatattcccataaataaggtcatttttcttcatatcattttaacctttcccccatttttttactatcctcacacacacttaccgttttttgcctgattacttcttgtataaatgacacgccacgctatgatcttcatctaattgtatcatagccggacgttcttttttacagatttccatacatttttcgcatctgccctgaaatggacagcctaccggaagctctaacggacttggagcttccccttcaattcctttaatcggcttggaaaagtccatattgatatcaaaaatagaatccatcaacgcttttgtatatggatgaactgcatttttagaaagcatagcacccggaagcacctcaaccacatttccaagatacataactgcaatttggtgagcacactgctgaatcaaggcaatatcatggcagataaatccaattgtaatattcttttcctgctgtagttttgtaactaattcaataatggttttctgtacggatacgtcgagcgcagaagttgcctcatccataataataatttccggttctaatgccagcgcacgggcaattgctactctctgtctctgaccaccactcatattatgaggataacggtctgcaaaatcccctggcaattccaccattttcaaaagccggcgacacactgcatctttttctgattttttaattcttttaaaattaagcaacggttcacagacaatatcacggattttcatctttggattaaaagaagaagtcggatcctgaaaaaccatctgaatattctgacggttttgtcttaattcctctccctttaatttcgtaatgtcctttccccgatataaaatctctccttctgacggagtatctaaagaaaccagaaatttcataaaggtactttttccacaaccagattcacctacgacacctaatgtctctcctttataaaacttcagactgacatcattgtttgcaactaacacacggccaccagaagcaggaaaacgttttgttacatgttttgcttcaagaataacctctttttgattagacaaatcgttcacctcctacggatggtactgcatttaacaaactctttgtatattcattttctgtttcatgaagaatatgttctcttgttccctcatcctcaatttttccatttttcataactacaatataatccgacatgtaggcagcaacacccagattatgggttaccacaataatacttgtcccataattatcgcgaagttccatcatctgacgtacaatctgcgcctgtgttgtcacatcaagagctgaagttggttcatctgccaaaaggagtttgggctgataagtcatccccattgcaattccgactctctgtctcataccaccggataactgaaatggataagaattcataacattgtccggactcgcaaggttcatacgtcctaacatctcgcatccttttgcccaggcttcttttttagagattttttcatgggtcagaatgtactctgtaaatacctttccaacttttctggttggattcatcatcgcaccactatcctgaaaaatcatcgaaatctgtgttcctctgagttttctccactgttcatttgtataagaaagcaaatcctgattttcaaacaaaacacttccctctgatactttaccgccacccgcaagcaagcctaagatggcacgaatgacagttgtttttccacttccggattctcctaccaaagatacaatctgtccctgcttcatgttcaggttaaaatgttctacggtaggctcatttttatatgaaatggttacatcctttaactgtaacatcttcttcctccttactcatctttcgggtctaaaatatctctaagagagtctccaagcatattaaagacaaccacaacgataaaaattgccagacctgggaaaatcataagccaaggtgcagactgaatacaagctcttccttcattgagcatataaccccattccggtgcaggcggttttgctccaaatcccaagaatgacatagaagccagttcaagcatcattccgccaatgtccgttgctgctgtaataatcagtgttggaagtgcatttggaagcatatatttaaagatcatgtgcggtgttttagaacccgtaacaactgctgctgccacatagtcacggtttctgatttttaaaaccaaacttcgaccaagtcttgcatatttcgtccagtttaccacaacgactgcaacaattgcatttttaatacttgcgcccataataccggctacagcaagtgctaaaaccaaacctgggaaggaaagcatcatatctgcaattcgcatgataatactatcgataattccgccaaaatatccagaaatgactcccaaaattgttccaataaaaaagattaatgcaaccactccaaatgtagcagtcaaagaagaacgggaaccataaatcacacgtgcaaatacatctcgtcccattttatccgttccaaagatatgtgccttactcggtgcaagcagagcatcatttaaatctccctttaatgggtctataccaccacttacaatcggtgcaaaaatcgcaaccagaataatcagaaccgccagaatcagaaaaaaagtaaactgcttattctgcgcaaaaaaatttttcttcttcattttttcttactcctttaatctcattctcgggtcaatataaatataagaagcatctacaatcagattgattaccatataaatcaacgcaagccagagtacatacccctgaatcaggttatagtcacttgaggtaattgcagatactgcaaggtttccaagtcctggataggagaaaataacttctacaactgcagttcctccaagcaaagaaccaatcgacaaaccaaacattgtaattagcggaagtaaagaatttggaaatacattacaccagataatacgggaacgttttacgcctcgtgcctctgccccaattacataatcctgactcagttcatctaacactgcggtacgaacctgtctggtatactttgaaaacattgcaattgccaaagttaatgctggaagaaacaggctcttaaaatcccctgcggaactgataaccggaaatatcttaatataaacgcaaaatgccatcataaggagcagtcccacccagaagtttggcatggcacagccgacaaaagtaattcccctgactaaataatcaatccacgtgtctttttttaatgccgatatcattccgagcggtacagataaaatcagcataatcagcatagacattaaggttaattttaaagtcggccaaagtctcacacttaacagttctgtaaccggcttatttaacgaataagaggttccaaaatcaccatgcaggcagtttccaagccatctgccatactgcacaacaaacgggtcatttaatcccatctcttctcttgtctgttctaccatttcttctgtcggcatcacaccatttgcggaatacatatttcgtaccgggtcaccaggtgacatgtaagtcagcccaaatgtaataaaactgataccaaataatacgattatgatttgtaataatcgcatgataacctgtttcttactcaaaaattttcacacctttcataagtctttaatcaaaccactatctctatccatatacaatgcccagtccaaaataagactgggcataatcttaaataaaacgctttcttattctgcgtctgccggaacaatttctgtcgtcagccagtagtaatctgctgtatgaatcttagcatatcctacatttttagaataaatcatactggagttataatatccgtcaattaaaactgctgcatcatcaatcagaatctgctgcatctggaagattaaatcttcacgtttatccggatccatttctgtctttaactcattgaacaacttatcatattcttcattggaatatgcgcagtatgtactttcagttgcccagtttgccatataggcataaggatctccagtacctactgtaatccagttattgttattaaagtcataatctaaggctgccagtttactccactggtcatcagagcttccatattcagcagtcacaccaattccgatttcttttaagtactgagtatgtgcatcagaaaattcatttaacagacggttttcataagaaatataacgcaggttaatattttttccatcaagctcacggattccatcaccatcggtatctacaattcctgcatcatccaataatttctttgcaccttccgggtcataagtataaggattgttcagtttatcatatccataagacagagtcgatggaagaacagaaaatcctggtgtataaagtcctccgattgtcttggaattacaaatggtatcgtagtcaattgccattaagattgcctgacgcagtgtcttatttccaagtacaccatcaaagttcatccaggagaatccacaacgtacacctggtgcaatatctactgtatagtcatctgaatcctggaatttctgaatatctgctacgtttgtgatattttcaaccaagtctacctgaccactctccagagccattgcctttgcagagttatctcccatatacatcagatttacttcgtcataaggaacatcttcacgataatttggatttgcaaccagtgtatatccaacaccgacaccattaaactctttaatcatgtatggaccggtaccgattgttccattatcaaagtttttggtatgttctacatccacaatgcccatagtcgggtgactgagctgtcccatcaagtttgcataaggctgtgttgtctggatggtcagtgttcctgcctcatcatctgcagtgattgttgcttcaaattccagatatttttccggttttgcagaaccagatggtccaacttcttttaagtgttcgtaacattcctttactttacttgctgtcagatcacatccatctgagaattttaatccttttttcaaagtaatgacccattccgtatgatcatcatttaccgtataactgtctgccagccacggagtaacttccatgttatcatcaaatttaaataaagtttctgtaataccgtaacgcattgcattccagccaccgttctcatcccctgcggtatttacacttccgtctgtgtacatggcacaaccgaaatttaaaaccttttcatcactgttacttgatgattttgcagcctttcctgaggaagaagaacttccacatcctccaagtacacttactgccatcacagttgccatcatcagcgctactacatgtttctttctcatttgcttcatccttcctatactggttcttcttcataaattacatttgccttttatagacggggacaaaagtctgcttctttttacgcttttttctgtttttaagcgcaaaaaaaccggataccaaagcatccgactgttaaagattcttaatttgataatagataacgtcaaaaataatctgctattttcttaaacataaatagcagaacgctttttcatctgtacaacttaagcttctcgtcttccgcaagaacttttgttaaagaggtaagcaggtttcctgacttaagcatacacatcaaaagcaccttcccagaataaactatctttccagtggcattttgcttttaaccagctatcacagtgacgggatcgtcccgaattcgcatcgggttctcttttaatcagacgactgtctgaacttatctctgtggcatattcgccaacattctataaataattttatttaacaccattaatatacaagataaatcatctttttgtcaataaaaatatcagataaaaccaaaattttatctgatatttttattttctcttagtcttttaattattttccaagcagttctttctcaattctttctcttgcttccggcgcctgtttatccatcttttccggaaatccaaacatggacacacacgcaatattatcgcctccgactttcggtgcatctgcttttaactgcttatttgcaaaatccatgtctcttaaggtttcaaagattccatcaaaatcaacatctccttctcccattgcaaggtgctgatgaatcgttacatcggattttcctcttgcatttaaccacggtggatttgcaatgtaacggcaatctaaggtctgattaaaggtatccgcaaataatacatgagtcaactcatctcctgcatagcgaagcatggaacgtacctctccttttccttcatcgtagaagaatccatgaggagaagaatagacataacctaaatttctggaacggaacgattttaccatatcgcaggtctcgttattgagttcacaaaaatcgtacggatgagactgaatttctacacggagtccttccctctcaataatcggaagcagttcttccatcgaacgaaaccacatgccattacagatttcctgctgattcgggtcaccggataattcggtattaataaccggaactcccatattcactgcgatttcaatcattctcttccaatttgcaactgccatcttacgctgttcttccgtcggaccggaccaacggtaaactacgatgaaagaggaaatttcaacaccggtttcccgaagtgcttttcgatattcctgctcacactcttttgaaaaaagcggatgtttataaaatggattaattcttggatgtggagactgctcaatatatttatagccccagtctgcgacctgatgaaccatacgattgatatccatctgttttgccaatacgtctacatcaaatgcaattttcatagtcttatcctgcctttcttaaactttataatccacaaaccttgcggatgtacttacgtgccttaattgcatattctaatggatttgcttttgcaggatcctgttctgcctctacaacaacccagccctcatagcctgcttcttctaagatagaaaagattggtgcaaagtctacatttccatctcctggtacagtaaacacgccttctctgactccttttaagaagctccatctctcagctcttgatttttccaccatttctttacggatatcttttaaatggacgtgtttgacacggttcacatattttttcaatacattttccggattaattcctgcaaatgataaatgtccactgtcaaagagtaaaaataccaattcagggtctgtcagttccataaatttatcaatttcttcttccgtctgtacaactgttcccatgtgatgatgaaaggttaaggtcattcctttgtcttttgcaatctttccgagtttatttaaaccgtctgctaagagtttccactcttcttcattcatgacatacttgccttcccatacaggctgttccatttttccctgaatactatagctctgctcagaaacaccaatcacctttgctcccatttctttcaaaaaatcagttgctttgataaattccttttctgtttcttcataaggtttggaaatcaggaaagaagaaaaccactgattgcagatagatatgtttcttaagtccaaagctttctttaacacagctatatcagtcggatattttccgcctacttcagaaccggtaaatccagctaatgccatctcactgacacactgctcaaatgtattctcttttccaagatccggcatatcatcatttgtccacgcaatcggagcaattccaagtcttactttattcttatccagcattttttattctcctttttccttgtttttaatatactccagtatcatagcaaccgcaccctctacgccggtctttgatacatttactaccatgtcatagtgtttcgggtcatctcgtttgattcccgtaaagtgttcataatagtcatttcttaatttatctctctgatttaaatcagccagtgtcattccatcataatattcttctgcctcttttgcacgatagtcatcatctgcatataagaagaaagaataggtatgaggagtttcttttaacacaaagtttgcacaacgacctaaaaatacacctggtgctttttttgcaagtcctcgaatcagacgactctgtgtctcaaacatttctacagggctcatatctccaactgttccggataccgaatacgaatacggcgagaacgtagtttctactgttccataattataagtatccagatatttctggacgctttccaaatccgcattttccattcccatcttttctgctaaaaggcagataatctgacggtcatagagacggcagtttaattcttttgccagttcttctgcaatttttcttccactgcttccatagacacgaccgattgccacatttatctgattttctgaaactgccatagacggaagggcttcttgtgtttctttcccttcttttccttctcttgcaattaattcctgcatcatcttgtcatacactttatccaatttataacaggctgcaattaagagcatcacgacccagattccaatcggcacatacagataaaagcctttaattgctgtaattgcaccacttgtctgttctgctgcggttgcttttaatccattaaatcctgctgctgccaaaattccactcatgattgcagaagtgataccagaacccgctttttgtcccatactcatagaagaaaacatcagaccttctacacgcagtccggatttccaatgaccatattcaatggcgtcacccggaagagaatactgtaccccataaaacggtgcaattccgaaccctctcataatacaggtcaaaacacccagcggaacacttgtaatatttaaaagaaaaattaactgacctataattccaagtgcacatcctgcacaaatcagatttctttttccgtatttcggtaaaattttcggaagcatcgcaattcccacaatcgttgcaactttttctgctgctgagagcggcattacaaggtctacatttcccaatacatactgacaataataagttaagtctgttccgataataatctgatatgcggtatagaaaaccatcaatcccaatgcaatcagaaaataacggtttgtaactgttgtcttaaatgcttttaagaacggaatattttcttttaccttcgctgctgcctgtacacgctcggtgcaagtcatataagtattaattaaaaccagtactgatacacctgcatagactgccgttacaataatccatgccatctgttcgttatggattatctttgccactttattaattaacggaagcgtaaatgcagtaattaccatacttgcagtaatggaaagcaccattcggatgttacagataacatcacgttctcttctgtcacgactcattaaagagcccagtgcgtggaacggctgactgattgctgtataaacaaccgtattcataatgttataagtcacaaatgcataaataatctttcccatacttccaattgacggcatggtaaacagtaagattgccgctatcgcataaggcagagccagacgcaaaatccagattctggcttttccatacttagaatgggtacgatcaataattgttcccatcagcacatccgaaaatccatcaaatacacgagataataacataatcattccgactgccccgacggaaattcctactacatttgtgtagaaataaatcaaaagtgtcgtagtcattgtgtacatcaaggttaatgccgggtcaccaaaacaatatgcaagtttctcgctgaccgaaaccttgataaattcatccatgttttttcccttctgcttaaaattcaacagttcaggtattccgccctttatcatacattttctccttttttcagacaaagcgggtaaaatacccgcctttgtcttctccctgttgttttattcttctcctgttttaagtttactcctatccaaaatatttttgtacaaaacttcttgttacttcggctgcttttttcacattttcttcgtgagacatttcataatattccggacggaattcctcgatagtgcaaactccatcaaacccgatttcttttaaagcagatgcaattccagcatggtctaccaccccttcttccggccagagacgtttatcatctccacaagagccaagcggaaggtcttcacagtcattcaaatgataagcaaagattttcttaccatctgctgctcttaaatcttctaacttggagcacatctcatggaaatggaaggtatctacggtcacacctacattttctctgtctactgcttttactacatcataagccgtaccgaactggttaatggaacagtttggagctccgcaaaattccagagaaatcttcatatctttgccgactctatctgaaagataacgaagtctttccactgcttcttccttgatttcagaaacagttttatcttttacatcaaaacttggtaccgtaattaacatcttcattccaattgctttggacacttccaaaatgaaatcaacttcctcatcaatttctttttctcctgcctcatctctctgattaaagaagattaatgtattgtaagcccatggttttaagtgatgatttttaaaccagtctgccagttcttctaaagtatgttcttttaagtactctctgacacagtcaaaacgaatttcaatataatcaaatccatatttttcacacatttccatatctgccagtaaagactgtcctttacattctaatgctgttgcttcgttaaatcctaatttcatcggttttttctcctttttctgattttctgattctgaaactgtcacatcaactcatcagggacagcttcagaatcttatttcaatttacccgcttatcgtcttatttatagaattctggtttttctactgctgtttcaatcttttcaattgcacctgtctcctgtgcttttacaagcgcatctgcggtaaccgctgcaagatatccatcccatgcatttggtcctttaatcacgccttcgcttgctgcgtctacccagtcctgaacctctgtatcataagcatctttaaatcttacgaagcagtctgtatcaatggtagtggaaacagctgcatttttacggatgcttgggtaaattggagacggcattttaattgctccatcttcacaaaccacttcacagttaatgtcgtatccaaatttgcagtttacaaagacttcaacatcaatgcacacaccttttttggtacgaagcagcataatctgtgggtcctttaattcagaatgagaatattttgttacttttggcataatcacctgagcggattcatattcatcatctactaaccagtgaagtacatcgatttcgtgaattgctgtatcatgaactgccatcggtgtattgtaatttgttccaacttccggatttctgtgtgtgcagtgaagcatcagcggttctccgtattctccggttgccagtgcttcttttacctgcatataacctttatcataacgtctcataaatccaagctgaattaaatgttttccagattccacttctgcatttactacttttaaacaatcctcagcagtggtacataacggtttttcacagaagattcgttttcctgctttgattgctgcaagcagagaatctacatgtgcaaatccaggagaaacaataaataccgcatctacttccgggtcatgaatcaattcatttgcatcggtgtaaacttttgcaccacagatttcagctgcctgttttgcgctttcttcaaacacatcggaaactgctactacttctgctccctgaattttgtttgtcagtcttctgatatggtcctttcccattccaccgcatccaattactccaactcttaacataatttttttcctccatcatctttttatttttttgttttttaatttttatttcgtgtttcatttgatgatgttattttagcatagtgtgcacgtgtacgcaatatgttttttatacaacttaaacacttattttttggacatatttacttttttctatttttaagctcttttcattggtattttttactatataattgattcttgttttggtaatttatttgagatgttctgttaattttttctcattctcaatagtttcttttattctttctttttgtttgcgttcacgtgtacattttaattcaaaaaagaattgaaatttctttttcattattgaaacttcaattctttttagtcttacatattgtatttggttttaattacaatttctgtatactgatactcttctttcggttctttatggtctaagaaaagccgaaataatatcataaccggctcatatccctgcacataagcatcctgaccgattaaaaaattaatcactcctttttccatccattttttattttcactcaagaaatcatttcctattactttaatagatttgccttttccaagtttttccagtgcctcgcagattccctttacggccggaccggttatatagattccagataaattcggatattgttcgattaattcttctacaatctttcctgctacccagtcatcatcgtaagaatatcttgtatgaatcaattctatctctggaaattcatccataatctctgactgaaatcccctcgccctattatttaatgatggattggaaatatgtccggaaataacaacaacctgccctttttcaccgataatttcccccatcaatcctgctgctgttcttccactctggattccgttttgcccaacataacataaacgtttcgtatcctcgacatcggaatttaatgtcacaatcggaatttcatattcttccgcaaactgtcggattttattctttaatacactatcctcggacggcactaaagcaattccagaatactgttcttcataaagcttatccataatttccataacactctgggcatccaccccttttaccggaaatacttccacacttccaccaagactttctacttcctgtttggctgccaaaactccttccaacaccagattcataaacggtgtctgaacggactgcagaatcactgcaatctttacattcttttttgccatagcaagtgcacgtcccgcacggcttggctgatatcccatttcttttgctatttttcggattctttctgcgacttccgcattaacccgccccctgtttttcaatgcacggtcaaccgtccctcttgaaacaccggcggcttctgctatctgctgcaatgttacaggcatatttttccctctcctttaaccttcaatactaataatctcttgtttagctaaaatacgctcggaatctcacaggctttcgccttcagaaatcccgagcgtattttaatcctgctctttttattttactacgtttcttttctaatttccacactcaatgctgatttcattgaatttggccagcacatcatctacatttaatgcttctttttctttcccttttttatctaagataacctttccctgatgcatcataataattcgatttccatactcaagagcataacgaagattatgtgtcaccataagtgaagtcagtttcttttcctttacaatctggtccgtcaactgcatattgatctctgcggttttcgggtcaagtgcagctgtatgttcatccaaaatcaaaaattcaatcggtgtcatagtagacattaaaagtgccattgcctgtctttgcccaccggaaagtgaacctacttttacatccattttatcctctaaaccaagatttaatggacgaagcaaatcctgatagtattcttttcgctttttacgcacgcagaaaccaagattgtaaggttttcctttattctctgccagtgccatattttccataattgtcatggatggacaagtcccaagagacggatcctgaaaaacacgaccgattttagaaaggcgcttatgttcactcatattcgtaatatcctgattgttaatcagaatctttccggagtccacgccaatacttccacagacaatattcagcatagaagtttttccggaaccgttacttcccactaccgcaacaaattctccatcttctactttaaaattaaaatcatcaaacagacacatttcattgactgttcccggattgtaatatttatgaatatgttttaactcaagcatggattttcaccttctttcttcgttccattcctactactaagataatcagaagaatggcagccgtaataaattttgtatccgttgatgggaatccaagacgaattgcaagtgctacgcaggctttataaaaaatagagccaatgacaacactgcttgtcacccttaaaattgtcaccttcttaaatacacttgttcccatgataacactggcaagtccgattacaacggtaccggttcccatagaaacatcaaaataacgctgctgttgtacaaaaatacatccacttaaagctaccagaccatttgaaacagcaagtccaacaatttttaccagtcctttatccactccaagagaagtaataattttttcgttatcacccacagcacgaagcagcataccagactttgtacttaaataccaatccagaaaatacttgctgattaaagtaatgattaagataataatcacagttttataaggaacaagtgcttctgggaaaatcttgtctaccactgcattttcaaaaatattcgaattattataaatcggcaagtttgctcttcctgcaattcttaagttcactgtataaagtgctgtcatcataataataccggaaagtaaatctcttacttttaattttacatgaatcagtccggttaatgctccaatgagtgctcctgccaaaaagcagattggaagcgttaaaagtgaattaaatcctttactgattaaagccgccgtgatggcggctcccataggaaagctgccatctacggttaaatccggaaaatccagaattttataagtaatgtaaacaccaagagccataatcgcataaataagcccttgttcaattacgctttgaattaaagccatcttttttgttcctccgcttattctacttcgatggaatcgaacatttctgctgcgtcagacacgtagctttcatccaatgtaattcctaagttatctgctacttctgtatttccgtaaaagcttggctctgtgattaattcataatttaattcagaagcttttgcctctccctttaatacttttgctgccatctctccagtctgttttccaagagaaacataatcaatccccatagaagcaaggcagccattttttacttgttctacttcagaaccaaaaacaggaatttttgcatcatttgctgctgcaagtacggtctgaagtgcagatactactgtattatctgttaagtttgtaatacaatctactttcgttactaagtctttcgctgccatttctacatcagcaattgtattaataccagtgtctacaatttcaaatccataatctccggccaactctttataggtagcaatcgtactttcagagtttgtctcacttgttgtataaagaataccgattttcttagcatccgggagagttgcacgaatcatctttaactgttcttctaccggaagtgcatcagaagtacctgtaatatttccaaccggggttccatcttctgttgcaagctgtgctgctaccgggtctgaaactgcggtatagataaccggaatctctgttccctttgtgctgttatatgcactcatagctgccggagttgcaattgcacaaattaaatctacatttttagaaacaaagttatctgcaattgttgctgctgtaccggtatctgcctgtgcattatctaagatgacatctaaattcacaccttcttcgattccagcttcctttaaaccttctaaaaatccttcacggcagttatccagagaaccatgctctgcaaactgggaaattccaactgtataggttgcttctttactatctgtaccttttgtatctgcagtgttttcccctgctgaactgtttccgcatcctgcaagtactcctgctgtcattactgcgcttaataccattgctaatacttttcttctcatctttttttctccttttcttgtctctgtattttcttaacaaaaacaaaacatgataggatttacttccgataggagtttctcctatgaaataaaaaaccgcctcaagcctaagcttgagacggtaataaattcttattatcgcggtaccactcaaattaacatttttcatgtccactttacgcatgtactatcatacactccttactgataacgggtttcggctccccgacagtgcctacttattttccatgttcggactgccctcaaaagtccattcagcaaatcaattcgtactgcatttcaccaccgcagctctctgttccttcataaataagcttactactctttctcatcggttttgcttttgttgtcattcattctaatacgaaatgttcggattgtcaaccctttaaagcaataaattttaaaatattggaggcaaaatttttgcccccaatcatcatttctttttattatcttacagtacgaactgctcctatttttaaagttgtactttctttatatggtcttactaacagataaacaaatccagctactaaaaggaatgctacaattgtaccaattccgaatgtaccagctgtgactaaagtaccaatctggtagacacaaagagatacaacataagcaagcaaggtctgatatccaattgcaaaccagaaccattttgcattgttcatttcacgtttgatagctcccattgctgcaaagcatggagcacaaagcaggttgaataccaggaaggaatatgcagcaactgctgtcatacttccggcaaggcttccccagatttctgtaccattttctgcaacttctgagaatccataaaggataccaaaggtacctactacgttttcttttgctacaagacctgtgattgctgccactgctgatttccagtttccccatccaagaggagcgaaaatccatgcaactgcactaccaactcttgctaaaatactgtggtcaagttccaagtcttctaacatacggaactgtccatctacccatccaaagtaagaagtaaaccatactacgattgtagaaagaaggataacagtacccgctttcttaatgaaagaccagcctctttcccacatacttctcagtacattacttacagtaggcatgtggtatgcaggaagctccattacgaatggtgccggctcacctgaaaacatttttgttttcttaagaataataccagagcagataattgctgcaataccaacaaaatatgcacttggtgccacccatgaagcgccaccgaataatgcacctgcgattaaggcgataatcggaagttttgcaccacaagggataaatgttgttgtcatgattgtcattttacggtcgcggtcgttttcgattgtacgggaagccataactccaggtacaccacaaccggttccaattaacattggaataaatgattttccggaaagaccgaatttacggaaaattctatccatgatgaaagcaactcgtgccatataaccacaggattccaaaaatgcaaggaagataaataataccaacatctgaggaacgaaaccaagtaccgcaccaacgccggctacaataccgtcgagaatcagaccctctaaccatggagcacagtttactgcgtctaacagatttccaatgacaaccggcacaccaggtacatcaaccagaccaaacagactccatccgtcaccgaatacgccgtcatttgcccagtctgttgcccaagtaccaactgttgttacagagacataatatacaataaacataattaccgcaaagattggcagagccaggaagcggtttgttacaattcggtcaattttatcagaagttgttactttatctttctttcctcttgtaaagcaatggtcaataatagaagaaatataaacataacgctcatttgtgataatactttctgtatcatcatccatctcttcttcaattttagcgatttcagcagaaacatctggaagattgcttacctgctcgctaattttatcatctctttctaagagcttgattgcgaagaatctcttttgttcttccggaacaataccggaaagtttctcttcgatggattctaagactgcttctacttcacttgcaaatttatgtaccggaatgttgcggtttttcttttctgcaattacaactgctttttctgctgctttctgtacaccagttccttttaatgcggagatttctactacttcgcatccaaggctttttgccagcttgtcaatatgaatcttgtcaccatttttttctacaatatccatcatgttaacagccatgataaccggaattccaagttccataagctgtgtggataagtataagttacgctcaatgtttgtaccgtctacgatatttaaaattgcatccggtctttcattaatcagatagtttcttgctaccacttcttccagtgtgtacggagataaggaatagatacctggaaggtcagtgattgtaacatctttatgtccttttaacttaccttcttttttctctacggttacacctggccagtttccaacaaactgatttgaacccgtcagtgcgttgaacaatgttgtttttccgcagttaggatttcctgccaacgctattgttgccatctttctacctctttccgccctcaggcatttctttctctaatctatcttatgttagtctaccaactattagtatttactaacttagatgcaaaaaaaattaatcaatctgaatcatttcagcatctgcttttcttacagataattcataacctcttacagttacttcaatcgggtcaccaagcggtgctactttacgcacatagacatctacaccttttgtgatacccatgtccataatacgcctttttacaggacctgtacctactaactttactacttttactgtttctccacaaggtacgtcttttaatgttctcatgtctgatgctccttttctatcctaccataattttgtttgccatatcttttccgatggcaactctggaatctttaatatttacaatcaggtttccgctgatctcggatacaactacaacttcgcttccgactacaaacccaagattttcaagaaatcttctggtttcttcttttccaccgactttacggatcacatttgtttctccggtttttaccattgttaaaggcatcatgtttcaccctctcttttgagaaatgttatcattacgtttctttacgttcacagttagtatatgctaacgtgcattagaagtcaagaactttttttgttttttataaaaatacagttgtaaagcagacattcgcaatccgttccgctacttgcttatctgcattcaagctttattgtcataaaatagttagtgtaaatcttttccaaatgtggtatacttataggaaatcgaagaaaaggtggtaactcttatgtatcatacgaatgaatcagctgaaaactatcttgaaaccatacttttattaagcaaaacccgccccgttgtacgctctgtggatatcgctgaggaactcggttttaaaaaatcgagtgttagtgttgccatgaaaaatctccgtcaaaaagaacagattactgttacaaaagaaggctttatttatctgaccgattctggaaaagaaattgcggaaatgatatatgaaagacatgaatttctgacatcctggctcactgctttaggtgtagactcaaaaattgctgctgaagatgcctgcaaaatggaacacgttatcagcaaacagagttttgaagcaatcaaacaacatgtacaaaaaaatcttaccctaaaataagatataaataaataataaaagaaaagaaatgttttgcgaaataaaaaagaggtatgagagaaacaaaaaagaagttcctattttgccggagcttcttttttgtttcaaactttcttgtttcaaatttattatcctttctttttttaatgtctgattgcttttttattgcgcacacactataatggaagatgtttgtgagaaaatttatttctgacactcacatcattttataaggagaaaaaggagaatattttaaactcatgaaacgattattgacttacctaaaaagacatcctctggcaacactctttgctccactttttaaaatgcttgaagcaagctttgagctgtttgttcctctggttgtcgccaaaatgattgatatcggtatctaccagaaaaatgccggatatctgtggcgtatgggtgctctccttgtcctgcttggaatcatcggatttggttttgcaattaccgcacagtattttgcagcaaaatctgctgtttccaccggacgagatttacgaaatgatttatttgcccatatcaacaccctttcctttaaggaaattgatacccttggaacttctactttaatcaaccgaatgacaaatgacatcaaccaggttcaaaacggaattaacatgtttctgcgtctgtttctgcgctccccattcgttgtatttggtgctatggttatggcatttacggtagatgcaaaagctgcgattccttttgtcatagtgattcctgcactggcagtcgtcgtatttgcaatcctgttaattaccatgccgctttataaaaacgtacagaaacagcttgacgatgttttactttccacccgtgaaaatcttctgggaatccgtgttgtacgcgcatttaaccgtcaggaaagtgaaatggaatcatttggaaaaaaaagcagccggcttttctttcgccagattcacgtcggaaaaatttctgccctgttaaatccggttacttatgttatcatcaaccttggtatcatcgccatcttatggtctggcggaaatcaggtttatcttggcagattaactcagggacaggtcattgccttaattaactatatgtcccagattctggttgaattaatcaaactggcaaacttaatcatcctgctttccaaagcaattgccagtttaaaccgtgtcaacaatatcttcgacatgcagccttctattaaagaagaaggagctttcctggcatctaagaccccaatcggaagcattgccggaactgctgctgttgaatttaaaaatgtttcattttcttataatgaaacagcaaaagaagttttaagtaacattacgtttaaagctatgccaggacagacgatcggaattatcggtggaaccggttccgggaaatcaagccttgtcaatttaattccccgcttctatgatgttcaaaacggaagtgtagaggtagacggaggtaatgtcaaaactttaaatccggtttctatccgcaaacatatcggcatggttccacaaaaagcccagctttttaaaggcacgttgcgagaaaacatgcgctggggaagaaaaaatgccactgatgaagaaatttatcaggcactcgaaattgcgcaggcaaaagaatttgtcgattccaaagaccagggacttgacctgatgattgaacaaaacggttctaatctttccggtggtcagaagcaacgtctgaccatcgcacgcgctctggttaaaaatccggatatcctgatccttgatgacagtgcttctgcacttgactttgcaacggatgccagacttagaaaggccataaaacaacaaatacaaaacagaaccgtatttttggtttctcagcgtgtttcaaccatccgcaatgctgatcagattctcgtactcgatgatggtacgcttgccggaatcggaactcatgaagaacttttaagagaaaatgaagtttatcaggaaatctgtgcttcacagctttcaaaagaggaggtgccttacagtgtcaaaacagctaactaaaaaacaatctacattaaaacgtatttttgcctgtattcgtccatacactccattggttttattgtccctgctcttttctgtgattacggttgccctgactttatatgtaccaattttgacaggacacggtgtggatttcattctttctaaaggaaacgtcaatttccatggtttgatttctattatcacaacaatcctgacatgcattgtaatctctgcattatgtcaatgggttatgaatcacattaataataaaatcacttataaaatcgtaaaagatttaagagttcaggcatttaaccatttacaggtacttccgctttcttatgtggacagccatgcctcaggagatttaatcagccgtgtcattactgatatcgaccagttttctgatggtcttttacttggatttacccagctttttaccggtgtcattacaattcttggaacaattgtatttatgctgagtattaatcctctgattactctggttgttgttgtattaagtccaatgtccttttttattgcaaactttatttcaaaaaagacttttattatgttcaaaaaacagtctgaggcaaggggagaactgaccggattaaccaatgaaatgttagagggaattaaagtcgtacaggcatttgggcatgaagaagaaacccagaaacaatttaaagaaatcaatgaacgtctggcaaattattcgcttcgagcaactttcttttcttccattacaaacccggctacccgttttatgtacgcttgtatctacgcaggtgttgcaatttccggatgtttcggtgttatcaatggaatgttaagtgttggtcagctttccagcttcttaagctatactaaccagtacactaaaccatttaatgaaattacaagtgttattacggaattccagaactcccttgcttctgcggctcgtgtgtttgaattaattgatgaaaaaccgatttctgatgataaagcagattctgctgtacttgattcaccaaaaggagagatttctttagaacaagttgatttctcttataccccagaagttccattgattcaaggtctcaatcttcatgcaaatccgggtcagagaatcgccattgtcggtccaacaggctgcggaaaaacaactttaatcaacctgttaatgcggttctatgagattaatggtggttcaattaaaattgatggacatgatattgattcgattactcgtcattccctgcgtgcttcttatggtatggttttacaggaaacctggttaaaatcggcttccatctgggaaaatatttcttatggaaatccggatgcaaccaaagaagaaatcattcaggctgcgaaagaagctcatgcacacagctttattatgcgtatgccagatggatatgatactattctctctgaaggtggaagcaacctctcgcaaggtcagagacagttactctgcatcgctcgtgtaatgctctgcctgcctccaatgctgattcttgatgaggcaacttcttctatcgatactatgacagaaattcgtatccagaaagcttttgaaaaaatgatgcatggacgaaccagttttattgttgctcatcgtctttccacgattaaaaatgcagatatcattctcgtcatgaaagatgggcacattattgaacagggcagtcacaaagaactgctttctaaaaatggattttatgccaccctttataacagtcagttcgctcctgtttaaattaatttaaccaaatcaaggaagtcccctgcttcaattgcgaaaagcaataagcaagtagcaaagcgaattgcgaatatccacttgacaatcatcagataaaaaacctgcggaatctcttgatttccacaggttttttattaacggtttgttcctttttctttctgtttattcatatacatagaatgctctgccttatccataattctttttctcagcctttatttttttgtggtcgaacactcacattgtcaaagaagctttttgttgtacccccccctgaaaaaattgtctgctcctgaaatttcaaataaagcaaagttttctgcctgtttttttaaataagaatctttatccacactcttttctaatttttcctgaatcttatcctgaatttctaccagacattccaaaagcatcggattaaaaattccacattccccgcctaaaatcatttccattgcttttttatgggaaaacgctgccttataaacacgtttactcgtaagtgcatcatatacgtccgctaaagatacaacctgcgcactgattggaatgtcatctccttttaaaccatccggatatcctcgtccatcataacgttcatgatgccatctgcagatttcataagcaatctttaccaattgttcattctgatataattccagattttccagtacggaagcaccgattaaagtatgcgttttcataatctcaaactcttctttcgtcaactttcccggtttattcaaaatcttttcatcaattgcaatttttccaatatcatgaagagaagaagcggttgtaattaactgctgctctgaccaagagagattatatttatccgttttctgctccagtttttccaaaatcatacccgtcagtgtattaatatgtaatacatgaggtccactctcaccatttcgaaattctacaatctggcttaagatactaatcatcatgcggttatttttctctttatcataaatctgatctgtaacaagggttgtcagcctgcgctgttttgcatacaacttcattgtattaaagacgcgctgataaacgatcatggcatcgaatggacgactgatataatccgaaacacccagctcataggctcttctaatatgggcattagaagattcactcgaaatcataataaccggaatatcctcaataaaacggtttttgttcataaattcaagtactccaaatccatcaagtccaggcattacaatatctaacaaaattaaggcaattcctgtaccattttcctcaattaagcttaaacattcctcactattttctgcctctaaaatttcaaaatcatcttttagaatttcggaaagaattgcacggttcatcgcagaatcatctacaatcaaaatctgttgttttgtctgctcttcttccacaaattctcgtactactccgtcacttccaatttttccattttcagagacaaccatatttttctgattttttgctctatacattaaacggtctgcacgacaaacggcactttcaattgtctcatcatttgaaagtacaccgccaatgctgacagaaagctgaagttgtgcatactctggaacttttgcatcatgaattttatctcgaatctgctgcaattctttcaaaaactcatcttcttttacgttcggaacaaccagaagaaattcatctccgccataacgaattaaaatattatccggaccaatgcttttttgaacaatctttccaatcgtctcaagtgcagcatctcccgcattatgacctaaaatgtcattatacagcttaaaatcatccaaatcaatcattgcaacacccattgaacctgtcatctttttaatatgttcctcaaaataacgacgattataggctcctgtcaaagcatctttataaactttttcattgtatctggcaaacttacttacaatcttttcctgtcccgcaacatctatcaaggatgtactgtccaaacacttaaacatttccatcacataaggtgtcccatcaatttctacatagcgcgctgtcacttgataaatatcagaatccataaactccagttttgttttctgagtttttccctcaaatgcttttaaagaaacacaattttcacatggacagtttttattccagaaatcattacaatgaccgtcctggaatttcatcctttcttcctgctcaatccgatgtaacaccatctggtcaatcagacgcacatttgtgaaaatctttttaaactgtctggtttcctcttttgcttcctgcatcgtcatcttgtaatccggttccatactttcttctcctctactggtttctcttaaaaaccttataccaccctgacaactgatggctctttctcctttatcttcctgaattttctatttattatactaaaattaaaatcaattgtctaccaacaaaaaagaaacctcgtaataatagacctctgacaaaaaacatctatcctcacgagattttctctttttaatgtccttttcttataatcgtcttaaaaatcaccaaaatcaaaaagataaccacttcaagcaagacaattgtcccacctggctttatgccaacataataggaaagcaccagaccggcaattgttgtaagcactgcaacacaaatcgcaccaattaaagtatttttataactttttcccatctgcatcccacaggctatcggaacaaccagcatggaagaaacaattaaagctcccactgttcttgaagcaacagaaaccgtcagtgctgttaaaatggtaaacataaaattaatctgccgaaccggaacgcctgaaattcttgccgcattttcatcaaatcccatataaaacaattctcgataaaacagcattaatgtcactaaaactgcaacactgatgatacaaacacctgccatttctcctgtactgatagaaacaatgcttccaaataaaaagctgttaaaatttgcactattttgtacgaagccggataacacacctgcaagcccgattcctgctgacataacaaccgaaatcgccatttcagaatatcttggaatctttttgcggattgcttcgattccaagtgccgctacgatacaagttgcacctgccccaagtaccggattgattccaagcaaaagcccaagtgcaacacctgccaaagaggcatgagaaagtgcatcccctatcatggacattctttttaaaacaatggtaattccaatgcatggtgtaatcacagccagtaaaattccaactatgaatgcacgctgcataaatccatactgcaatatactcatcattcctctataatccttccttcctgtgcattccaaaaccgatttgccccagtataaggcttcaagcttccatgacttaccataagaattgtaagccctttttcatttctcttttgcagaacttcacataaagactgaatcgaaacactgtccatcccggtcgtcggctcatctaaaattaaaaattctggttttcccactaacgcccttgcaagcatcactctttgctgttgaccacctgaaagttctcctatccggcttgtcaaaaaagaatccatctccatctcagacaatgcttctaaaatttttttctgatatttttttccgaaaattccacgcttccagattggctcataaagcccggttctcataatctcctctactgttgccggaaaattttggtttttactgatactgttttgcggtacataaccgattttcattcctttaaatccaccggaaatatctttttcaaacattttaatacttccttgttgtggtatcagttctctcaataacagcttcaaaaatgtactctttccacttccgttttcacctgttaagattacatagtcaccctgtctgattttcagatttacgtcttctaaaaccggtacatctgcataatgaaatgaaatatcatttatctcaaccatattcatgcggtttccctcctgttgtcctatctttccacattaattttccagcgcctttttaatctgctttaaatttgtcctcataacagaaaaataatcttctcctgcatccatctgttcttcgctcaatccctccagtggatttaaaacctctgttttcgcaccaatttctttcgcaattgtattggctacttttgggcttaccagttcttcaaagaaaatggtattgatttccttttttttcgccaactgaataatttcttccattctcgcagggtctggctcagaatccggcatcagaccctcaattgctatctggtttaatccataagctttgcaaagataaccaaatgctttatgtgctacaatgatatctttattggtcacctgggataatgtctcttcaaactcctgatttagtccatccaactgcctgctgtatgtttcataattcttgttataatactctgcattatccttgtctgcctcaatgaaggcatctttaatatgctccatttctatcttcgcattttcagggtctaaccagacatgcgggtcattttcttttccttctcttatcaattccacaccctctgaagcctctactgtaatcaactcagagttatccagtgattttaaaatatcctccgcccaatgttccattcctgccccattgtaaataaacacatctgcatcttccatatttcggatatcaattgcagaaggctcccagtcatgtggttctgttccagatggaaccatattggtaatctctactttctccccaccaatcttctgtgcaaaatcatacatcgtataaaaactggtcattacctttacttttcctgaatcatccgctgtattttttatcgcattctgaccacatgctgtagtacatcctgcaactataactgccataatcgaaagtaatcttactgtctttttcattgcttctcctatctattcttttttacttttgaacttatctatgcaaaattgaaaatcattttcatattatagcaggtatttttgattcgtcaagttttttataccaaaaaagacctctttcgatagattttcctacccaaaaaggtctcttctttccttttcttttcagtttttaatcttcttcaatatgattccgaccctggtcaataatcgtcctcacatgatcatccgaaagggaataaaatacggattttccctctctacggcttttcacaagtttattttgttttaaaatccgaagctgatgagaaatggctgactgtgtcatattcaaagcctttgccaaatcacagacgcacacttctgcttcaaacaagacaaacagaattcggattcttgtcgaatcaccaaagactttaaaaagttctgccaaatcgtaaagctctgtctcttccggcatcatttcttttacaattttcaaaagattttcatgcagctcacaggattcgcaaacttcttctgatttttctgtcataaaacaaatgctatcctttctcttattgatttttagcttttttattctataaattttttacaaacaaggttctgattgcatttaatacggcaattaccataacccctacatcagcaaaaattgccatccacatatttgcaattccaagtgcacctaaaatcagacagagtactttaataccaattgcaaagtaaatattttcatatacaatgcggatacatttttttgcaatcttaattgcctttgaaatcttaagtgggtcatcgtccatcaaaacaatatctgctgcttcaattgccgcatcagaaccaagtgctcccattgcgattccaatatctgctcttgaaagtaccggagcatcattaattccatctccaacaaaagccagtttatctttttcctctttattggcaagcagttcttctacttttgtaactttatccgccggtaaaagttcactgtaaacttctttaattccaagttcagaagcaactgcatctgcaacatttttgcggtctccggtcaacataactgttttagtaacacctgcttttttcagttctttgattgcttcttttgcatgtggtttaatcacatcagaaattaaaatatgtccagcatactttccatccagtgccagatggacgattgttccaacatgactacaggaaacataagaaattccaagtttttccatcaacttttcatttcctgctgcaactgttattccatctacctttgcaaccacgccatgtccgctgatttcttcgatatctgttacacgatttctatcaattgatttattataggctttttgaagactcttactgattggatgagaagaagaacactctgcaagtgctgcatactctaataattttgcatcttccatctcattatgatgaattccgcttacttcaaatacaccacgagtcattgtacctgttttatcaaatactacacattttgtctgagaaagagtttctaaataattggaaccttttacaagaacaccctgattgcttgctccaccaattcccgcaaaaaaactaagtggaatactgataaccagtgcacacggacaactgataactaagaaagtcaaggcacgataaatccagtctccccattccggacttgctcccataaataacagtctcacaagtggaggcaaaatagcaagcgcaagtgctccatagcagactgccggtgtataatattttgcaaatttagaaataaagttttcggattttgattttttagaacttgaattttctactaaatcaagaatcttggaaacagtggattccccgaactcttttgttgtctggatttttaatacccctgacaggttgatgcatccactgataacttcttctccgacagagatatctcttggcacgctctctcctgtcagagcactggtatttaaagtagatttaccttctgtcacaattccgtcaatcggaactttctctccaggctgtactacaataattgtaccgatttctacttcatccgggtctacctgttccaggtttccgtctacttctatatttgcataatccggacggatatccatcagctcgctgatgtttctacgactctttccaactgcataactctggaacagttctccaatctgatagaacagcataacggctacgccttctttataatcgccaagcacaattgcaccaatagttgctactgccatcaaaaagttttcatcaaatacctgtttatttaagattcctttccatgcttttttcagtatatcatatccgattaccagatatggcaccatataaagcgccattttcagatatccatctacaggaagaaaggaaaggattacgagtaataccgctgcaataataattcgggtcagcatctttttttgctttttattcatcccctgctcctccattttctttaaaagtcaacttttttgtaaatttttaaaatctctcccgcaccactaaaagcagttacagaagagactctaaaaacatcagtgagtaacactctttacttttgacactcacatctttttgattgtatcttagaaaaagatttcgcaatcgtcttctacttttttacagtttttcagaacatcctgcatcactgcttttggttcctgaccatcttcaaattctacaatcatctttaaagccataaagtttacagttgcatcttttactcctgcagtatttttagcagcttcttccattttgtttgcacagtttgcacagtctacatcaattttgtaagtttttttcatgatttttctccttttctactcacatttgtttatatgagcacttgttcatatatttgtttgactttattatagcatatttctttttcttgtcaatactaaatttttcattgcatttcttttttttatacactatactttatccggaattgaatttacttctgcaaataaaaacatcttgggaggcattttatttatgaaatacttaattatcggcgcaggcggcaccggaggaacacttggattttatatgacaaaagcaaaaaaagatgtaactctgattgccagaaatgaacatttaaacgtaatgaaatcaaagggacttactttggaaaaattatggaatcatgaaaaagaaacccttccggtaaaagcagtttctatagaagagtatcaggaaagacccgatgtcattttagtctgtgtcaaaggatattccttagattctgtcattccatttattcaaaaaattgcaaaaccagaaaccattgttattccaattcttaatatttatggaacaggtggacggatgcagaaacaccttccggaactttccgtcatggacggctgtatctatgtctctgccaatatttcttcttatggtacaattttacagcatggtgaaattcttcgtgtcgtgtacggtgcaagaacacccgaagaattgcgtccagaattaaaagaaatccaaaaagatttctttgacagttcgattgagggaattttaagtgaccagataaaacgggataccttaaagaaattttcttatgtttctccgattggtgcagcaggtctttattggcaggcaacagctggagaattccaaaaagaaggagaacctcgtgaaatgttcaaagctatgattcgtgaaatttcggaacttgccaaagcgatggggattccttttgaacaggactatgttgccattaatcttgatattttgtctgctcttccaccagaaactacaacttccatgcagagagacgtcatggcacataagccatctgaactgcaaggacttgtctttgaagttgtacgtatgggtcaaaaataccatgttcctgttccgatgtatgaaaaggtcgctgaaaaattgaaagctttaatttaataaaattaataaaaaatactgccggactgaaaaaataagcttcagccggacagtatttttttatttaagaaatcaatcaattaaaagtttaagataataaattattcatactctttaatgtgataagtaatgttgaggtattatgaagcagtgcagaagttgtcggcatgataactccgctgactcccagcagaatcagggaagtgttaattcctacaatttgacgataatttcgtttgattcgtttcatcagaccattactgataaatttcagtgtcacaatctgatataaatcatctgcgctgattgtaatatctgcaatctctcttgcaatctctgcaccatcactgattgcaattccaacatctgcagcagaaagtgccggcgaatcattgattccatcaccaatcataatcactttttttccatttgctttttcattttctacaaattttgctttatcttccggaagtacttctgagaagtactggtctactccaacccgctttgcaattgccgatgcagttctttcactgtctccggtcatcattacgatgttagaaattcctgcttttctaagagaattgataaccgcctcagcttcctcacgaagtgggtcttcaatacagataacggctgccagtttattttcaattgcaagatataaatgagagtattcttccggaagtgctgcaaattctgcttcttttccagccggaacaacacatttttcatcttcaaatacaaaatgatggcttccgataattactttcttaccttcaattgtacttgaaataccatgtgctaccatgtattctactttagaatgcatctcttcatgttcaagatgtaatttctttgcttcatttacaactgcttttgccatagaatgagggaaatgctcctccaaacacgctgcaattcttaacagttcgtctggattttctccgttaaaagaaatgatatctactactgtcggttttgcttttgtaagagtgcctgtcttatcaaatacaatggtatctgcctctgcaactgcctctaaatattttccaccttttactgtaatattataaaggcttgcttcacgaatcgcagaaagcacagaaaccggcatcgcaagtttgagtgcacaggagaaatcaaccatcagcaccgataaggcttttgtgacatttcgtgtcagaagataggtcagggctgttccacctaaagtatacggaacaagacggtctgccagatgctccgccttgctttctgatgcggattttaatttttcagaatcctcaatcattgtaacaattttttcaaaacggctagaaccaccaacttctttcacacgtactgtcagttcgccctcttcgattacagttcctgcatagacagaattgtgttctactcttcttaccggtacggattctccggtcagagacgcctgatttaccattgcttctcctccggttaccacaccatcaaacggaatgactttacccatacgaactacaacttcatctccgactttaatatcagaagcagaaaccaaaatttcctggtcatctttcttcatccagaccttcttcacatttaaggataaggaacgagccaaatcatctacggatttcttgtgtgtccactcttctaatagctcaccaattccaagcaggaacataacagaacttgcagttgcaatatcatcacgaagaacagaaactccgattgcggttgcatctaataccgcaacttcaagttttccggtgcaaaggctacgaacacctgcatagatgtattttaaagacttaaatgtggtataaatggcacgcaccggaaatggaatcactgcttttgcgatatatctgcatgcaactttcgtaatcagtttttcctgatagtctgcatttaattttcttccggaattcgcaatgacttcctgcggtacatcggctttttcataagaaaatgcacgtaatgctttaatgacttcctctctgtctccgacataagaaatcgcagcgtctgctgttctctcatatacttttacaaaactaacctgtttattctggtgtaaataatataacaaagtatcagcctgctcataactcattcgtttctgcataagatgcacacgcattctgccctttgtctcatgttttatttgaaatttcatttgcatgtcctctctttatctgtatagaaaagatatcaaaacacctgcagagatctgcaggtgtttaccaacttaaaatgaatgaattattcttctgtttctgactctacttctttgaattcttcaacagcttcttctgtttctgcttcttctgtttcttctgcatcttcaaattcagctgcttcttttttggctgctctttcttcatttacatttttggctgcttcatagatatcttctgcattttcctgaaccattgttacgactttcataacgcagtcttttgctcttaaaacaagagcagtgccctgtgtatatacgttctttgcgtcatcgcttgataatgctttgattcctgctgttccaaatgctacacctgctgcaaaaattccggtttttttccagtcaatatttttcaaacaatttaacatcctgtattcctcctgctatttcgtatttttttgtttaaatgacattatacaacacctttttttacttttccagcattttccttgttattgagaatttttatcacttttctttaaaatcacaggcgttctatgtaaactttatacttttgacacttacatcatatgatgattttttttacacgctgacctttttttgcatagccacaagcttctaaaccagcctccatcacctttttccacttttttgaagtcagcttgcagacactgttatcttccagttcaaccatacagcttccttgttggggatgtctctttgtctggttttcaattttatacatattttttctgcttatgacacccatttcttcaagtttatttaccatacgatatacggtagccactcctatctcagggtctttctgcatggcacggtaataaatttctttgcaacatgaacagtctccttcaaggataatatccagcaccagctctctttgtctggtcattcgtccgccctttgccttaaatttactcacaattctatctttctgcatttgggtatactgatacaaaataaaattttctggttcttctatctgtgtcttaccagacattcctatccctcctgcctgttcaaacttctttcattgttagtgtatactaacaactattagtagtcaagaacttttttataaaaaaaacgccgtttttctgtttttctccagaaaaaagacgttttctattctttcttatctttttttaactaattacttattaaaaattctattcttactttttataacaatacatatttcagtacaaacaagactgcaagtacatacatcagcggttttactttctttgcttttccgcaaactgcatttaataccacgtaagaaataatgccaatagaaattccctctgaaatactgtagaatagtggcatcgcaataatacacagataagcaggaactgcctccgtcatattatcatctgtaaatttgatatcggtaattgcaccaaacattaagaatcctaccataatcagtgccggagcagttgcaaaagatggaattgctgtaaaaattggtgcaaacagcatggaaatcaggaataaaaatcctgttaccactgctgtcaaacccgttcttccacctgctgcaacacctgccgaagattctacgaacgtagtcgtagtagaagttccaagaactgcacctgccgctgttgcaattgcatcagacatcagtgccggtttgattccaggcagtttcccatttttatccaacataccagcttttgtgctgacaccgattaaagttcccaatgtatcaaataagtcaacaaacaggaaagaaaatattacgataataaagtttacaattcctaccttatcaaaatttacgttaaagcactgcccaaaagtttcacccagttttgaaaaatctgtcattgcaaaacttgggaataaggtataatatccaagttctgcattcggaacatagattccaacgacctgacaaatcattccaagaatccaggtagataaaattccaactaagattgcaccttttacatttttgatataaagcacaactgtaataaacagaccaactactgcaagaattgagcagattccggcagagtggaagttttctttaaaatttgtaattgttacaagtgtagactggtttaatacaaccagctttgcgttctgaagtccgataaatgcaataaaaataccgataccaacagaaacacctttctttaaatttaatgggattgcatcaaaaatcgcttctcgtacattggtaagggaaagtacaataaaaataagtccctctacaaatactgcaagcagtgcaacctgccattcgtaacccattacaccgactacggtatatgccatataagcatttaagcccattccggcagacagcgcaaatggaagatttgcatacaatgccatacagattgttccaataaaagaagcaagacatgttgcaagaaggactgctgttgcatccattccagcagcactcaatacacttgggttaactgcaaggatatacgccattgtcataaaggttgtaatacctgcaattacctctgttttgactgtggtattgtgttctttgagtttaaattttttttctaacataattgtttgcttttttaagcacgctctcctttcttttggtttaattttcttttcccacttcttaataatacagggaaatccgtctctgcgtcaatataaaacagataattcaagcttaatttctgttattgtaacatctttaataattccggcgcatattttgaaactactagccaaaaggaagcaatcatcgccactgccgaacccaaccagaataacaacgtattgactattccatctgccgtacatagtctcaggcaccagccatttccccacggataaagcagacgcacttttcgtttattaagtaaatcaatcataatatgggaaagcattgcaattgcaaaatagagttccacttccggatacataaatgccacaattccgctaaaaatcaacagacctaaaatagaatgcataaaagatcggtgtggctgattctttccaaatgtacacacgataagcatcaccgcaaagcctatgataaatcgaaacaaactgctttctctgttaaaattcttaagaattcccaagtgaaaaatacattccagtattaccacaactacaaatgccagacaggaaactgcagtaattttattaagcgcttcccttgagtctgacgtactgacatccacatcactgattacagaaccaacaactgccgctccgatgcataaaacccagtctcttaaatggggcggttgtgtcacgcataatgccgcagcagttcccaccgccaaatgtgtttttcctgtcatctcttttcctttctcctttcctaaaatctgtaatcttgaagtttttcttattcttccgagactacctgaatcacagccgttttattatactctaccacacaaaagctggcaagcaattccgcctaaatttcgctgtttttcttgcatttatgcccttctggacttataataaaaccatattacaatggataatccaaagggggattttacaatgaatcatgaactttatgaagaggcaattcattccgatgtcttatctgagaaacttatcagtcagctcttagaaagcatggaatacagcagtatttcttttattaactggagcattgaggtgctcaaattaattcgtgttcgtattgaacgcggcgataaaatcaaagatgaagtcagtggagaaatctatacgaaaaaaagctttcacgcttttgtaaaaaaacatttttcttcctatattgaaagccaggtatttgcagacccggctaaagcggaaaaaatttatttttcactcgaaccatgtaaagacggtgaatacaatctggttatggcagaatcttccaaaaagaaagtctatgaatggatttcctctttaaatgaacgcttttcactggtagaaatgatttcaaccggaatcgtttatataaaggacattcgttctaacacttatcagccttttatttctaaaaacggaaaatactgccattataataaagaaaccggacatattgttgaagtttaaaacccaaaaatcctcaagcagacactatctgctcgaggatttttttcttacctttcattcttatttcttctcttctaccgcctcaagacctccggttacagaatccataataaatccggtaattttaattcctgccggcatcaaaggatgatgtttcaacgcatatacggtatcttttacggactgttctacgctttcaaatccacctaaccatttttccaaatctgttccggtactcttaattacattaatgtgttcctgtgaaactcctctttctacgagttcctctaacatgtgatgtccatccattccctgtacaccacaatctgtatgaccgattaccataatttcttccacaccgagttccaaaattccaactaacagacttctcatcacacttccgtaaggatgcgtaattaccccgccggcatttttgataatcttagcatctccatttttaatgccaagtgccgctggcaataattcggttaatctggtatccatacaggttaaaatcgccagtttcttatccgggtatttacttgtcaaataaggctcatacgcttttttctccacaaactccttgttgtactttaaaatatcttctatcatacgcacacaccgttcctttctttccaggtttttcctgtaagagtctgtctttattataaactttttttcaccctgctacaagcaaaatctaggagaatctgccaactctgcaaatcccccttttttcctcaaaccagatattttcttaaaatcttcttcatttattttaatgttcttccagccagcgtcttgcacagtgtgccagacagcctgcaccaatcgggcagacctcttcattaaactgcacctttggatgatgagcaggatagtcgcctctctcatcaagataaccagctgacaaatataaaaatgaacttggaaccttttccgcaatgactgcaaaatcttccgatgcacttgaagagacatccggatgtggaatcagattcggaatctctaattctttcatatatcccactacttcttttgtaagttcagaatcacaaatcaaaggcggtacttctgaaatcatctcaattgtcgcacttcctctgtaaacttctgcggtcttttccaccacttctttcattctttttactaaaagttctcttgcttctttttcatttgtccggatagttccctgcaacacagcagtatcgggaataatatttgctgctgttcctgcctcaaattgtccaatcgtcaatacacaggaatgacttggattacattctctcgcaatcaattcctgcaaagccagatggatatgcactccaatattaatcgggtctactccaacctgaggatatgctccatgagagccctttccctgaattgtaattttaaatccatctacggaatacatcattgtattcttgtcattatacatatagagtccgaccggaaatctgcctggcgatacatgataagcaagtgctacatccaccttcggttcttctaaaattccatgttccaacatatttttacttccctggaacgtttcttccgccggctgaaacatcagcttgactgttccctttaactctgcttcctcttcttttaagatttttgctgcacttaaaagcatcgctgcatggaaatcatgcccacaggcatgggctgcccctgttttactcgaaaatggctctccactttcttctttcatcggaagcgcatccatatctgctcgaagcagaataacttttcctccgtttccgattgtagcagttacgccctctccacattctacaggctcaattccatactcttttaattttttcatcacaaatgcttttgtctctggcagatgcagacctgtttctgcattttcatgaagaaaccgacggtttgcaatcgtttcttcctttaattccagggcatgttcatattcattcatagtcatctctcctggttttcctaaaacttttcttttttatttttctacaaatttttcttttaacttggtcattttttcagaataaacctgttcacgttttttctgagcaacttcattcataacctttactttcacttcttcaaatggtgcttcacatgcttcgtttttcttttctactttaattaaatgataaccaaactgagtttttaccggtcctactacttctccgatatttgctgcaaatgctgcatcttcaaattcttttaccatctgaccttttccaaactgaccaaggtctccgcctctctgagaagatggacagcttgaaaattcttttgctgcatcctcaaatgttttttctccattctgaataaatgtcagaatttctttacatttctcttcagaatctgtcagaatgtgttttgcacttacagttgcacctttctgataattgtgtttatttgcttcgtagtatgcttttgcttcttcttcggtcacatttacttctttcatgatattgcgaagtaccatctgtgctaagatatcctgttttgctttttcaatctgtgtcaaaaattcttcagattcatctaatttttcttcttttccttcttctgccagtacatacagcgcaattatctgttctttgcagtagtcacgaaactgtggctgtgttgcataaacctgctgttctcttggcagagtctgaatgtaatgtgttacttcctcttctgtgattttgtgtcctgctacaactgcaattacgttttcttccattttaaagtatctcctttttgtgataaaaaattccggacagtacctgtaaatactgtccgggaccaaattactgttttattatatgaaattttcagctctttgtaaagattatttgtatcgttttatttattggaggatttttcatttaagattatttgtctaagcttcttcgtattaatcgttttttacgttaaaggctttgatacccggataaatagctgcatttcccagttcttcttcaatacgaagtaactggttgtattttgcaactcgctctgttctgcttggtgctccggtcttaatctggcaggtatttaatgcaaccgctaaatctgaaattgtagtatcttctgtttcaccagaacgatgagaagaaattgcagtataaccagctttatgagccatcttaattgcttctaatgtctcagaaacagaaccaatctggtttaacttaatcagaatagaatttccgcatccaagttcaattccttttgaaagacgttctgtatttgtaacaaataagtcatcaccaaccagctgtactttgtctccaagttctgccgtcagtttcttccagccttcccagtcctcttcatctaaagcatcttcaattgagataatcggatatttctctacaaggtttttccagtgtgcaatcagttcttcagaagtaaataccgtaccggcttttggaagtttgtattcgcctttctttccggttttccattcagaagatgctgcatccattgcaattttgaagtcttttcctggttcataacctgcttttttaactgcctctaaaatagtttcgattgcttcttcatcagattttaatgctggagcaaatccaccttcatcaccaacagatgtcgcaagtcctctttcttttaaaatagaagcaagtgcgtggaacacttctgcacaccatcttaaacattctttaaaggacggagcaccaaccggcataatcataaattcctgtacatccagtccggaagataatgcatggcatccaccgttaataatattcatcattggtaccggcagacgatttccggaaattccgccaaggaaacgatacagaggaatatccagtgcatttgcagctgctcttgcacttgcgattgatacagcaagaattgcatttgcacctaacttggatttgtcttttgttccgtctgctgcaatcatagctccatctacagcatagatgtcagaagcatccagtccatgtaaggtctcattaattgttgtattaatattttcaactgccttttcgacaccttttccaaggtatctttcttttacattatctctaagctccagtgcttcaaattctcctgtagatgctccacttggtgccattcctcttccgatagttccatcttttaagatgacctctgcctctacagttggatttcctctggagtccaaaatttctcttccgattactttttcgattgttaaatgactcattgccatgtctcctctctgtttgttttcctctcattttacaactcctttaccggaagcttggtatcttccggtgaagaaagactcaggtaatcttccttcaaaggagttctaaaatgattcagtcacacgaagttagttttaactaactatttgtattatacaaaaagaagaataaaaatgcaatcccctgaaagtgatagtttttatcagtaaatttctgattctcttcttttaacagtcattgaacttttacaaagccatcttatcgaataatgaaattcaatggctgttcttctaaagaaacttctactaccttttttactcctgcgttttccccgtctgtatgaatcggaacagcctcttccattgtcagtactgcctttttacatctttcaatatgtaccatttttttaaatatcacatgctttccgaaaaatgccgttggcagtacacatagaatcattaactttggaagtttttctaccagacaaatatccaaaaaatcatcacagggttctgcctctggacaaaacaaaaatccaccaccctcataacgagtattcataaatacagaaaataaaattcctctctgatattcctttctattctgattatctaacaccagttctgcctttgtatagggatatttcatcaacaattttaatgccgtaaataagtaggttaatttcccaaaatgtaaaaagtttaacatgtttttgattttcgactgaatcgaatgatggcagactgctgcatcaaatcctgctccgctgctgattataaaccttcttttttctccctcttcttcctcattatctttagttacaatttttccaattcttaccgcttttttctcttttggatgaagaataaaggctaaagcttcaagtggctcttttgaaagtccaagtccccttgcaaggtcatttcctgaaccggttggaatataaccaaaacttaaaaatggagataagattaatccatttaccacttcatttactgtaccatcccctccgattgcaacaatggtacatggattagtttccgaaacctgcaaagacgcctctcttgcaagacgctttgcatcacctgttttctttgtagcagcaattttatagttaatctcttctttctctaactgttcctttatctctctccaaagcgttttatgttttcctgaacttgaagaaggatttatgataaaatagtaaaacatggtattattccttttcctttgttttttcttttaactttaatcagaattgagagatttttcaatagaaagtttatgtaaaagtttatggatttggaaaattaaatttgggtaaaataaaaagagagcggaacaaaaagaatctcatcttttcatttccgctcttctttatttttcttattctacttcttccggttccatgcttcgcagatgttctttgatttctccgatatcatatttctgactatattcggttaaataagaataatactccgtattatctgccggataaatctttgaattgtgaatatggatatcagaagtatcttctccactcttcatcagtgctaccatagcacttgcgcagtgagatgcgatacgtccgaagctatttaaaatatcattaaatacggttccttcttccagaccacattcacccttgcttaaacgttctgcatggtgcattttcaattcgtcacatgaccttgtaataatcacgccaagtggtgcaactctctgtgccagctctctgtcatcatttacaaacgcattgcttgtaatattaatcacttcacgaaccgcttccataaccacatttaattcatcccaggctgtttctgaaaactctgtatgattttcatgcatttcatttgacatatatccaatataagaagcatgatcaccaattcgctcaaggtcattaatcatgtgaagatataaagaaacctgcttcgtctgtgccgtgttcatctctctttttgtcaactgaacaagatattctcccagacgactctcgtatttatcaatcaagttttcttttctctgtactttattgaatttatcctgctcatagtcattaagcagattcattgcacggtttacatttttgcgcacttttttcgacattccgttcatgacacgatgacactgtgcaatggcaagcgccggataattaagcaaacgttcttccagtaaatcaaaatcttcttcatcttccagttcttccgcactgtcttttaccagccagcatactaatttttcaactttggaaataaacggaaacagtacaattacggttgctacacggaatacagtatttaacagcgcaatggctaccggtgtcataatcatatccataaatgtaaaatgcacaatcgcatttacggtataaaaaacaatggaccacaaaatcagaccaaacaagtcattaatcagataaacaagtgccgttctttttccgtttttatttgctccgattgcagagatcaaaaccggacatgcagcaccaacaccaattccaagtacgattggaaatgcacttgcaaaggttaaaattcctgttacggataatgcctgcaatacaccaacggttgccgatgcactttgaagcactgcggtaaataaaataccaactaaaatacctgcaattggatttgaaaacatcgtaagcatgtctacaaagaccggattttcacgaagtggtgaaaccgctccactcatcatctgcatacctgtcatcaaaattgcaaaaccaagcatgatatttccgatatttttatgtaccgtccttttacaaaccatgcgcagaattgtaccaatgactgctacaactgctgaaattgttgctgtagataagacttttgcaattccacttgaaccttcaatataggaaagacataaaatccagcccgtaatacttgttccgatattcgctcccatgatgataccgattgcctgtctcagtttcatcataccggagtttacaaaaccgattaccattactgtcgttgctgaagatgactgaataacactggtaacacctgttccaagtgcaactcccttaagtggagtattggtcatcttgtacagaaaagcttctaacttgtttcctgcaaccattttcagaccgtctcccattaaggacataccaaacaaaaacagggaaactccgcaaagcagcgacaaaaccattgaaaatatttccatacttttctcctcttttatccgttttttctacctatatcttaatataaggatatgatttctgtcaaaaacaaacgaatttaacattttcttaacctattcttttcttgtttttaacattttcttttttattatgccacatcacctcaatgattacaatctctggattgtcgaaaaaacaaaaaaatttttacaggttctccattattttctacaaattttaattttttaaacatttcctattgactaacacacaaatggatgctctatttatagaaattataccgattttcacttaaataaaaaatcctgtacgatacagctcttcaaagcatatttcatacaggattttctttatttagataaattcaagagatttacttttccattttctgttttacatcggatgcaatcgaaaccgcagcattaccataaggaatccaggttgcctgaaatgcatgatacaaatctgattttcctggccataccgtcccaatcacttcatttttctcattcaactgatgaaaccaggaaccgttttcatggtctaataccttttcatccagatatttcataaatttactataatcctctgcatatctccggttgtttgtaatctgccacagtactgaggaagtattaattgcctctgccaaagtccagtgcatcctgtcatgaatcaccggatttccttcccagtcagtagtatagacaagtccctctgcgccatcgacattccaggcatcttttatcgcacgattatataaagccttggcagcttctacatattttcctgtcaaaatacttgaactttctgtcctataagtagaaagtgcccactggctgattaatctcgcccactcaattccatgtcccggagtcgcaccataaggtttaaactggtctgccggctgttctttattacactccaaatcttctttccagtcttttgtaaaatgttccggtattctaaaggaattttcagagaaccattttatcacatgttcgataatccctcctgccctctgacggtatttctcatccgagagtgcatcagctacagccaaaaatgcttctactgtatgcatatttgcatttaatccacgataatcatccaaaaccgtaaattccgtattccaggtatctacgcaaagtttctctttttcatcccagaagcgcaaatcaaataattccaaagcttcttttaaaagttcctctgctccatcaatctttgcaagcatggcagacgatgcagataaaattacaaatgcatgggcatagcactgtttatttggcaaaatttcaccatcggcgcgaagtccgctgtaccagcccccatgttcggtatcctttaacgctccttttaagccttttaatgcgctttcagctaatgccttgctccctttatcaccaagcatcgttccaatgctgtatacgtgcagcatacggcttgtaatccatgtctcacgatttctgtctttccatggagttccatcatctccgagatagtaagaactgccatctggcgctggaaactgtcgcccaaactccaggagattctttcttatctcttctaaaaactccttattttctttcgtacctatctgatattttctattctcaccttccatttacaaaaccctcccttttttcgtgtactctcggaatttttatgcctgttttatcatgcagtattgttttaaatgaaagccttttttttgcacgactccatataattgaaagccaaatttttcatacatcgccacatttgccggattatgtgtctcaagcgaaatcattaatttatttttatatgcataatcaatcacttcatccatcagcttttctgccagtccatgatgctgagctttcggtgcaaccgcaagataaatcacatgaagccgctgattgctatgaagctgggaagtccagcttgaattcaaataatcctttccctgaataaatttccaaagtgttgcaagactcgggtcttccttaattaaatagctgtctgtctttaagaccgcaaaaaaatccactaaaagattatgtaacgctgcatcatgttccgttccatccgagacaacaagaatgctgtttaattcgctgctgtctgcatagatttcacaggtttcaaaaaattctgtcaaatcacagctaaacagttccggcatcagtctttctctcgtctccttatctggaatcaatgcctgatacagcggatcttctgcaaaacacactgttaaaagacgaatcagtttttctaaatcttcttctttgttcactcgatataaatttgagctttccatattttcctccaggtcattttaattttcctcaaacagtacaatcgtttcttgaagcatctccgagaattttgtaaccgcacgaatcaaatactcaatatcatccttgtaatatgcgcattgacgctcccatacttcctctaagtgcctctgctccagttcaagactgtctttatctatttctttatttttcagcctttcgaccaattcatatagattttcatgatgcagaatccttcctttgccccacatcaaacgttccggctcttgcttcataatatattctgtaaaatgataaaacacttctttttcaaattcaaatgcatagcagttattatcaatactgtaaaatgcatccaatgtttcctcaatatttccggcatttaatgcagtcttcgctttttttaatgcatgcagattattctgtactgcctgctgtggaaaaatcactccatcatcccagtctaaccgcacaaaataatcttgcgctttcttaaaaatagcaagcagtttttttgttattgcatctgcccttttccagtctccatctgccccaaaattctgattccagctttgtatcttttcatagagacaaattgcagtttctcttgctttttttgtctgctccaaaagcacacttccctctgcacctgtttgtttacacacattcaaatccagactgtccatacttgcagttaaaacagttgcgaaattaagcggcggtaacgccagagcatcaacttccatcaaaagcttaagataaaactcatgatgaaactgatacacctcctcctcatacacgtcctgattatcatattgtgaatgataataattttccataaacggtccgccgctgaaatcatttacaaaagacgggattcctgaaattgccattgtaaaatcatccgaccaggtttctatcggatataacgttgtcattccatctggataaatcccttttggcatcgcatctttatccacaaacttttgaataaaatcaacatactcatacgtacagcgtatcgcatctttcgtactgtgagcatgtgccggaagttcaaaattaaaatccgcaatgacgtttcccggccaatccgctcttgcctcaaaaacctgacggtaagcccctgtagaccagtcatattttgtgtcagaaatcccccactcctctgctgcaagcgcacaaaccacaatggtatgatttggctgataaccaccttgaattaaagcttttgcaattccgattatcattgcaactgctgcattatcgtcctgaaatccttcaaaataagaatcataatgtgcacttaaaagaatcatagaatccgaacgttttcctggaatttttccaataatattataagtgtactggtctttctctacttttgtctcagcatccaattccaccaaaagatggggcacactgttttcttttttattctcatttttactctcttgcatcaattcccaaatttctaaaaaatctgctcttgacatagaaaaagcgggagctgatgccggtcctgcaatatcctgtgcattcaaagccgtatcatcaatctgagcatatccgcggctttgcacggcaattaaagcttttgccccttttaaatgtgcctgataaaccggataattaatccaccactcctctctttgattaatttcaattaagaccaattttccttttacatctatattctcataatctttggctgttccttttttcagataaaccaggtcaaatctttcaaatccatctgtcttaaaatcagtctgatatgcccccaattgaatttcttttttctcgcctgtcttagtctgatagcgcatcactgcctttttaaattcccaggcatcgactgtaatcttgtctttatgtacgtcgacaagacctgcttttttcatttcttcaacgagcatatcccccgtttttcgttctgccaaagaacctgctgtacgatagcccaagataggattcgttttttctttttccattcgtcttgcaagctgataagactcttctacctttaagcaggaaagacaattttttaaagcctcttgaaaacttgagttctccatttttctcatcttctttctacgttttttgtctcttccaatcatttctttttctattatacgcttaccagtactcttgtcaatttattgcgaacccaaaaacaccttatctctaaattaaaaaatgacaaaaactctgtctttttttaaccaaatcaaggaagtcccctgcttcaattgcaaaaagcaataagcaggtgtggggacttgcttgtatcaggaggggcaagccccttctgataagctgcgtagcagctatttggttatgagcaagtagcgaaagcggattgcgaatatccgcttgactacacacagtctttgccatttttaaaccaaagtatttttttcatatttttttctataatttttcggagaaatttccatatgctttttaaaacaatttgaaaaataaatttccgaaccaaatccaaccagtcttgaaattttccgaatatcataatctgtccgtaataaatactgctttgcatactccaagcgaatttctactaaaacctcaagtggtgtttttccaaaagtttctttcatcgcttttgcaagataattccggtgcaaatgaaactgctgctccagaatctgatttgtaatcggatgttccagattattttccagataaatctgaatctgttctgccagcagtgtcagtctgtctttatgcatccctgcattttcaattgtctttaaaaatcttaaaaataattcttctgttttccagatatcatgttcccctgccgtactgtccagtatattctgaaacaattcaaacagcaattccggctccttaatagtcgaatatttttgcagatgcagagtatacgaacactgatgataatgttgtcctgatatcggaagctttgatacaaaacggctcgccttcggtccttgtttccactgtgctgttgtataaaaatgcagccagtaaaaacccgtatcttcctgacagggtttccaggaataatggtgtctgtccggcaataagataaacatttcattttctttgacttcatactgtttctctccttccgcaagaaacagagcgcctttttttacggcaatcaaatcaaaaaagcctagattttttcgttctacgtggctttgcccctttctcataattttataatttccttctataaaatcaggaaaaggcggaatggaaatggaaatcatatcaccggacatctatttttaaaccctttcttttttcagcgtaatcttttgcaaacctttttcatttgcaagctctattatatcaccatctgaaataaaataaaatcccctgctgtatggtgcaaaacttgtgattttatattctgtatccgtttcttcaaaacttccattgataaccagaatagaagtctctttttttataatgaaagctttatctccaaagttctccagataagcaaccagctcctctcccatatcccagtcaggagtctggctgtcattatcaaataactttgcaaaaattcctccatctctataaaacgccgactgaccaaagcgttctcttgaaagatccggtcgatttatatgtggtcctgcaactgcataagtagatgctgccattcctttttctaatggagaagttgctgttgaatgagtatcataacagtaaaggattcctgccgttgcccgataacctgcctctaaatatctcgtatcttttaatttatcaaatactttataagcagaagcagccgtaactcctccccataaagaatgaatcatataggtcaaagcctcccaccagcggtctggattttgagccctaaagtcattggaatagccaatattggcaagtaaaagcgctccatattgttttgcactttcgattcgcccactttcacacagcgcaccggctgttggtccaaaaccggcattgtcaaaaaaatgttctgtgatggctgctttataagtctttgcctcctcatctattttatccatcacgctttcccagattgctttgattttattatattgttccattctaccttttttctttaatttatctagcaaacgttcaaaatacaagaaataaacacctaacatctgagattcttcttttcctcgttcctcttggtggagttctggatttacccttaattcaaatatttccgttgcccattccaagtaggtatctgcggtattgagcaccagtgtttcatcctcaaattccgataacaggtaaaacaaatgtgcaatatattcaaagtccatacaacgataaaaatctccgtatagctttctcggttttctaaaatcaccgtcgataaaccattttggacgtacataattaactgcacatttttctactttctgaacctgactggcatctaattttccaagcagatttttttgtaaaaccagatttgcttttccaagagattctccctgattggaaatcggttcaaatgcaaatggcggataaattgtctcatcatgatacaatttatcacagatatattccacacgttcttcaataaccgtttcgattttgtccattacgttaagcacaacaaaatcttcggtatcattatcaaatcgaagcacaattttatgttcgcccattgcagacggtttaaaaatcagctgatactgttctttattttttttgtctcgacagacttctacaactgttttctttctttcatcctgcactttataaaaagcatccgccgaaaccatagaaataccttccggagtttctacagatatccttgacacttccccgataatattaagcggtgtatattctacctttggatgtctccatttgagtccttctttataaaaatcttcttccccttgatttgcgctcatgacatactgccagtttttcttttctcctgcttctaagttaaaaccatctttttcataaatccagtcatgattcttaaaaccttctggataaccgccagccagatataatttatgaaataacattccatccaaagacggagaaacatcttcaaagaacaaatttaaataatcacagtaagttcctactgattttgtctgtccttttatttgataaaacccaagactttctccacttccatctctgcgcaccatgcttaatttagtataatccttagaaataaacggaaacactgccgctgaattatgaatgtttttcagcacatttttatcccgaaacatcacataagcaaacgaagtccaaattccaaattccttaatattcattcttttttgactcttattttccagctcaatgctccaaaagagtgcttcctcatcttttcctaaatcataaaactgttttactttaagagtctcaaattcatagacaacttcaatccctttctctgtttcttttaaaaccggaacactcatccgacttccaaacttctctttatctgctataagttcaaaaaaaccaaataatttatctgcgtctttataatttttttcctgtaaataactgtcctcaatcacccagttcatctgatatgggtcatctttcatggtcagatttgatacatacccctctttgtttacttccatacggaatttcttattttctatcatcatataatatttcacacctttcctaagtttaaatttatcatcctattacgcttattgctatagaaaatttcaatcaaaacttaagaaatttcacactcacgaatcattagagtaaatttaacattttttcatatacttcttcgttcttctcaattattaatgtcaatcgttcttttgcctgatttaattgatgaaaaagacttcttacttcctgttttccttcttctttacagacattcgttctaagatatcctttttcgtcataataataagcatcattcaacaccatgacaagctgttctgcttctttattctcttttatctgtcctttatttttttgatattcatagccctgtcggatataatcctttagtagattttttgtttcttttttctcatttgcatagaccacgtccacatgaggataatttcttgttccctttttatccggcagatgcaggatattttgaataaaagaagataattctgcattggtacgaatccggttggtcagatgaaagctctgaatctgtggtagattttcaatcctctccatgacactttggtccatttcatccggagaaatcatatcttctgaatcactggaaaaaattactggttgatgttcacttaactctaataaaatttctaatttttctaatgtcagaagatgtgcttcatcgactaagattccactataattttttaactgtaattcatgatttaactgcttatctgaaagaaaatcaatccgctgtaacctctcatgtaataatttccatttttcttcagactctccacaatgaaccatacagaccctctgttttttcgctgaaagtttcattgcaatatcataaagtaataacgtctttcctgtacctggaagtcctgtaaaaataaaatatcccgatttttctgcccaaacccgtttcaatatctgtcgttcaatatctctttgctgtgaagttaaaaaatattctttttccaaaaaacggactggctctgtcaaaggagaaatcaaatataattccgcctgaaataaatcttcaatctcgccctcataatctgcactattcttttgcagggcactgcataactgttcccagtctgcatccacgatatggtcatgattcgtcagctttaccagccgtttctgactgctgatgtaggtataagataaaatagattttccaaacacagacagataatacttattttgaagaagctgttttttgattgcatcttctgatacacccccgctttttaattcaatatttacaatctgttcttcttttatctgaagaaggtcaaactccttacccagctttggtatctgaaaagaataaaaaaaacgcaacgcagacacatctgacatttgcaattccaactgttttaccagttctttcatactgtctaattcccactcacgcatttttaaaaaatattttctgccagataaatgacgttctaatttttgcagacattctatcttttgatttcgggtaagcgtataaattgatattgatttcatttttactactcctgaaaaatttttcaatcttccctattttaaacttaatttgattaaaaccaggactgaataccactattctatcctactttcctttccctgtcgagtcagcttgttaagcaggtactcgcaattgaagcaggaaacttccttaattcggttaaacaaaaaaacagtcagaacaacttctttttgtcctgactgtttttctaacaatttatttgttttttattttcttgactgctctattgtgcatttatcatggcatgccacctctaattgtgaacttctctcaatgtatgaagcatcactctgcccaggttccatttacaaaaatatctgttttacttccatcctcacggattcctacaatgcgcaggtcatctgaccctaccataaagtccatgtgaatcattgaatcgttgatgcctctttcatggatttcttcctccgtcatgtccataaatccttcaatgacttctgaaaatccacgtccggctgcaacatgacagcaggcattttcatcaaataaggtattataaaacatcagacctgactgattaattggagattcttttggaacaagtgcgacttctccaagcatagaagctccttcatccatcgcaaacatttttttcagaacttcctctccctcttctgcatgacattccacaactcttccgtctttaaaatcaacggtaaaatgattaatgacctgtccagaacggctgagtggttttgtggaaaccagacgtccctcacattttcctttcattggactggtaaatacttcttctgtcggcatatttggaacaaagaatgtctgattgatatgattgacgtcgcctgcacttccccattttgcaccaggaatcagctctactgtaaaatccgttccgttactactggtataatgaagagatttaaagttctgctcattcaaccagttcgctttctttgtcatacgctcattatgtgcctgccagattttctctgcatcttccccatcttttaaataaacgcagtcaaaaattgcattccataacttgtcaactgctacgtcttctggttcattcggaaatacttttttcgcccatttttcagaagctgctgcaacaatcagccattgatgttttccgtcaatctggtcacgatatttttttaagactttctgacgcatctgatttacagttgaaattaaatccggtgaaataccggataattcatctgggtctgaagaatcaataaaaatacgaaccggcagagtttctgtcatctgttttgcacgttcttcctcccatactgcaacctctccaagtacatccgatgttgcatactgataatgcagtttattcacttcaccacaggaccagaacaactccacataacttgcaccagccttataacactcttctgtaaccatttttacaagcggaatctggtctacttcagcctgcagacgaacccgctgacctttctgtacatttgctccaatttttacaatcagcttggcatactctcttaatttgttttcattcattgtaaacaatctcccgtcatttaaattcttatactttgtgatttatttcagacatcttatttttgtcttttatcactgttaattaagagtatacctgctttttattagcttcgcaaggataggatttatctttaaaaaatatccagcatattatcaagataaattgcttctcttacatgaatctgatactccggttttgtcatataatagagcagaaattccaaaatcagtgcgcttccaagcccacgtccttctattttaaaattagaaaatcccattggcatgtagacatttctaatatcttctaatccaatgaaacctggattggttattgcctttgaaaagcgatatccctcccctgcatttggtgcactacaaggatgctctgctccattttctccaagatttttccgactaactgcttcatagcagattttcctgtccctgcatcccaaccagcaacattcattacagagaaattctactttatctttttgttcttctgaaagtgttttccatttatccaatgctttatttaaacgaaagtccggcacaacatagccaaactcttcacgattaatttcttttcttaactcttcaaattcagttaaaactttcgtagtagaagaaacaaaatacagatttgggtaatttactttcaagtagtctaataacaaatctgaatggataattatgccattttgtttttcttttcccttattaaacaatgcacacagcgcattacatcttttatccgaaagatgttcttcttttaataaagaattactaaaagtcaaccgtgctgaaattccatattcctgcataagttctaaaacttcctgtggtctgctgtctccacattccacacgaccgccaccccagaggcagtcccacggcgctccataaatggaaccaatttcacaccagtcataaaaatattctctatgtttccgaaacaggggtaaaaacaagcgataaagttcatagaattcaaacaaacccggaagatgataataggcttttcttttttttaattgtgtcatatctcattttcacctttttctatattttttattttactcattttagctaatagtactgttgaaatcggcattaccaaaacgcaggcaatcgctcctagaagcattgatgcacagctttgaaataaaattttagagttaagcaaaaattctaaggagtcatttctcatttttaaataagaaagcaataacagagattctccaaaatatgcaaacaataatgtattaatagttgttccaattacatcttttcctactcgtattccactttcaattaattctttatttgtcatatccggtttgtgacttttcacttcatataaggaagccgtaactgtaaaagccatatctatcactgcacctaatgtactaagcaaaattacagccacttgaactttttgcatactaatatctaagttcatatcgtagtaaagaacctcttcgcctgccgattgaatttcatttaagcctccagccctacttccccatattactccttgaactacaaatactaaaacagacatcgtaattaatactgcaataaaagcactccatgtttttatattcgacccattttgataaaacagtgtaatgtaagacactatagcccctattaagattattaataaaaaaacaggtaccccctctgccataagccagattcccatactcaagaaaaataaatttccacacagagcaactaaagacattccacctctgtctccgccaataataagaatagaaatcaataaaatcaatcccaatacacctaacatattcttttctttccttttacagatatctttattataatcgaagtaataacaatagagacaggtatcgcccatacaattcctatacattcaatgagaaaacggcatatttcacatgggatgtttaattttataattgtaataaggcggacatcattgttcatttgaattaagcacattggaattaattcacagacaaacacgcacattaacacatttaacatagttcccataatatcataaccaatttctcttcctgattgaaaaagctgtccaaatgttacatttgattttttctcaatgatctcacttaatgctgcggatattgcaacagccacatccataactgctcccaatccagaaaggataatttctgcgtgaaagatttcctctgtattctctatatttctcagacctaaatattccatggtcgaataatctaaatcactcctgcgaacaactacatcaaatattatcataatcattgcaattacacaaagggttgaaagcaatgccgcccatgtttttctatgtatcccatttaatccgattaatgtaactactgcaaataaaattacgatttcattacaaatttttaatatatttgaagtatctcctaatatccaaaatccaactatgaatactatgatgtttatagttactgtcataaacgtaaatattccttgtctgcctgcggttaaaatcaacattataattaatattccaagcaagcttacgattattgtatcccgttttaacccacgtacacctgttcctatgtcatctacagaaccatttaataatactttatcccctttatgataaggttgcctcaacattccagtatctgtatattcattagaaaaatgaacttcttttcctttattctttccattcaatataattccctgaattttctgtttatatcttgtctcttctgttcctcttgtacttctcacctgacctgatatgcttgtttccacctttgttaactttgcgattggagtatgatatagccatgcatcattcattacaaatagaatgctcaataagtagaaaattccaataatccaatattttttttcaaccaacttaataccaacaaacatttttattcttttaccctcatgtctgcatttgcaagtctgcaaaatgtcgtatcataatccttttctttataagtttcaaatgttccctgaacttcaatttctgtatcttctgccggatattcatctgggtatttatgcgagccatctccccagacaaactctaatccttgcgcacaacatgccctcgcatcttttataatgcaatagtgatagcatgttcctgccgaatactattctttattatttctacactcattacaaattccatagaaaacagtacgcaatgagtccatttcaaaactatgatgttccatcatatgtttttttaagctttcaacctcatcacaatgtaaatgaatcaatttcccacatttttcgcatttacaatgataagaacattctttttctactgtttgacaatttcctgtatactcaaaacatgcactgctggttccgtctacaacatactttgcgaccactccctcttttaccattttttccaaatgacgatataccgttgtcgttccaaccgatattcctttttccttaaaatagtcacaaatctcatttacagtaacatgttttccttgtacagattctaaaaatgtaagtaactcagccatttgttttgttttatatggtgcttttgacattttaactttccctccaatttggaaatcattttatcacaaaaacttcttttgtcaacataatttgaaaacaactttcattttatctaaattctatttttcttctattctaactgcttcattttttcatgtcaaacttgattttatttcacctatgtactatcattaaaaagcacaagcaccagaaaacaccaaaaaaggagactcttatttttatgcaaacaaataaagattttctaggcaccgagccaatcggaaggctccttcttaaactgtctgttccaacggtaatcgcccagctgattaacatgctttacaacattgtagaccgaatttacatcggtcatattcccaagagcggaagtctggcacttacaggagtcggtgtctgtatgccggttattatgattgtatctgcatttgcggcactggtcagctccggcggcgcaccacgcgcttctatttttatgggaaaacaggaacatgactctgccgaaaagactttaagtaactgttttatacttcagattatcatttctattattttaacgattattttacttcgctggggcaagaatctgttgctggcttttggtgccagtgaaaataccatccaatatgcagtcgactatctgcatatctatgctttcggtacactttttgtccagttgacgctcggaatgaatgcatttattacggcacagggatttacttctgtttctatgatttctgtcctgattggtgcgatctgcaacattactttagacccggtttttatttttgcttttcatatgggtgtaaaaggtgctgcacttgcaaccgttctttcacaggctgtttctactatctgggtcgtactctttctttgcggtaaaaaaacacagattcacattcgaaaggactatctgcctttaaaagcaactattattcttccctgtattgcacttggactcgctgcttttatcatgcaggcaagtgaaagtattgtagcagtttgctttaattcttcacttctccgctacggtggggatattgcagttggagctatgaccattttaaccagtgttatgcagtttgccatgcttcctttacagggaattgcacaaggtgcacagccaatttccagctataattacggtgctaaaaatgcagaacgcgtaaagaagacatttcgtattcttttaacgacctgcctgacgtattccatcgcactctggatgaccgtacaactgattccaaaagtatttgtaggtattttcacctccgacgcagaccttgtcaactttactgcgcctatgctgaaaatttatcttggcggtctgtttttatttggaattcagattgcctgccagatgacttttacttctcttggtaaagctgtaaattctattatcgttgcggttgttcgaaaatttgtattactaattccgctgatttacctgattccgcaccttgtatccaatccagttatcggtgtttatatggcagaaccgatcgcagatatcattgcggtactctttacttctgcgctgttttcttttcagtttaaaaaaacaattgcagaaattcaaaactgaattttaatgaaaggaacttaccatgaatacactaaagaaattcattcactactatggtccgtataaaacggtcttttttattgaccttctctgtgcaactatcattagtcttgtggatctctcttatccacagattcttcggactgcaacaaaaacactcttcacgcagaataaaagcatcattcttcatgcccttccatggcttggcatcggattacttttaatgtacataattcaaagtttttgcaaatattatgtcagctatcagggacacatgatgggagctaacatggaacgggatatgcgtcaacaactctttgaccattacgaagaattatctttttcttattacagtcaaaataattccggtcagatgatgagtaaactggtcagtgacctgttcgacatctctgaatttgcacaccatggacctgaaaatctttttatttcactagtcaaaattatcggagcttttatttttctcttttttattaataaaaaacttgctctgcctttgattctgcttgtaattgtgatgtttctcttctcttttcatcagaatcataaaatgcagcaaacctttatggaaaacagaagaaaaatcggtgatgtgaatgcaagcctgcaggatactttatccggaatccgagtggtacagtctttcacaaatgaagagattgaaaaagaaaaattcagaaaaagcaatcacgcctttcttgtttccaaagacaataactacaagtgcatgggggaatttatgagttccaatctgttcttccagggcatgatgtaccttatcaccttaatctatggaggttatctgattgccaatcatgaaatgtatcctgctgaccttgccatgtatgccctgtatatcggaattttcatcagtccaatccagatcttggtagaattgatggaaatgatgcaaaaaggattctctggtttccgccgttttcttgacgtcatggaaactgttccggaaattcaggataaaccagacgcagtagaacttacaaatgtaaagggacatgtctgctataaagatgtgacgttccactataacgatgatgaagcaaccgtactttctcatgtgtctattgatatccctgccggaaaatctgtcgcactggtcggtccctctggcgcaggaaaaacaactatctgttctctgcttccccgtttttatgatgtaacaggtggtcaaatcacagttgatggacaagatgtccgctctcttaccttaaagagtctgcgaagtcagattggtgttgttcagcaggatgtttatctgttctccggaaccattcgtgaaaatattgcttacggaaaaccagatgcatcagaagaagaaatcattacggctgcaaaatgcgccaatattcatgaatttatcatggaactgccagaacagtatgatacctttgtcggcgaacgtggtgcaaggctttccggtggtcagaaacagcgcatctctattgcacgtgtattcttaaagaatcctccaattctgattcttgatgaggctacgagtgctttggataatgaaagtgaacgctggattcagcgcagtctcgaagaactctcgaaagatcgcacgaccattactattgcccaccgcttgtctactatcaaaaatgcagacgaaattattgttctcacagaaaatggaattgcagaacgtggaacacatgaaagtctgcttgagaaaaacggaatttatgctggttattacaatctttctaactaatcaaaattagatcagatttccggctatattcaaaaaatccgagagccattctatcactttagctctcggattttattttttctctctataatagacaagcggatattcgcaattgaagcaggggacttacttgatttggttaaactaccgcatttcttttttctgaaaaaactacggtcaacttgtcaatcactttattacaaagcactgtataaagtgcgccaaatacatttgctccaatacgaagtgctactgccattggcataccaaataaacctgatgcaattgacaatgctccaaatgtattaaatacggtctgccatgcatatcctgccgaatatcctactccgattccgccaatcatgccaatatagggatacatggattctggaagaatcagatacagcacaataaaaaatacgcacccaacgatattaaactgccatctttttcctgatctggcaacacagtcttctgtaaaaggaaggcatacagacatgcaggcaatccctgcccacattgctcttggcaatcctaaaagattcatacccagcattgcagtagaaacaatcaaagtcagcttcagataccatctgcctcttgctgactgtaagtcaaattctcgaaaaagatccagaaacgttcttcgatacggacgattcttctggtttttataaaagataaccatacaaagaatcattcccactgcaagtccctctactctttttatgtattctgctcctgtcacatcatatccaagcaacagcagatatcctaatacaaaagtagaatgattgtacataattacattgtggcaacctaaaatcatcagaagaagaattgcaattacatttactaaaaaagccggcaatggagacaacatattggcaatccttggtgctaccatcaaaagcccaaaaattcctgcgattgaaaacagcccatgcgtcgttttaatcccaaaatctgcttgtcgaagaacaagaaccgccaacaataccgtaacacctacgacactgttttcactcccaattagtttactgtacaaagataccactgcaacacaaaatgccataaccaaataaactttaaaattataaatcagaatatgcctgcgtctctcttttggatctttcgtgtttttgattaattgttttgagcctgttgaacttaactgaagctcttgataaaatgtcataattttcgctccttttttctcaaagtgtagagaactataccgcaaatacgacctgttgtcaagaacaaattaaacccaaatcatgctcttttcaccactgtgaactactcggcaactaagttaccagagtatctgaaatctgacgggataccgcatttctctcggaatcataacaggtcatcagactatgaagtcccggatcaatcgataaaatatttactgatttcttgtatcttacctctctattttcctttcatgtataaacctgctttcaacgccaaaaacagaaatcgaacaccatcattttcttttccgtaaatttcaggaatatcatccacttttggattgattttataaaaagtattacttttatctgcacctgttctctcctcaatcaaccttctcattttactgataggcgtaatactctccagctcttcctctgaaaaacccagtgcaagtccaagatttgcatctggatccacatctacagcaaatacttttttcccttcttatgcatacagacgtgctattactgcagatatcgtagttttccctactccgccttttccagttacagcaattttcatctgttacctccttaaatgcttcttactccacttcctccagttctgttccttctgaaagaatatatccgcagttatcacatactccgtcctctgcaagtatcccgtctttcacaaaggcttcaatgcctcccggttcatgacagcgtggacaatctaattcctgtatctttttctgatttcttacatcctgacaattggcaaattcgattttacccatagtgattcctccattttcattccatatcaatttgtcttcgcaaaaaagttcctaccatacgagaaaaattgctgatattacgaatataggcaaagtcttttccatagattctcttttccacggagagttcttcttcattccctacaaaaataccaattacgaaaatcccctgatttctggcccgacgcacctcatatgcagtatctttcacagctccttctccgtcatagagcttgggctggcgggttcctggtcgttgtatgctcatatcgcaaggttttccatcacttaatacgattaaaatcttatttttttccggtcgctccataagagaggaacagactgttttcagtgcaagcccatctctgttattagcataggcccgaaattgaaagattctttcatttgtttcccttggatcttcataatcccgaaatctctgaagtactgtatatccccagaaagcacagtatcctgtcacccgatgaggaattcctgcctggcttaatgcttcactgataatatatccctgtgccgctacctgagcctgtctgccagcttgggaaccactggaatcaatcaggacgtctattgcaaactcagaatcttctgatctcttttttctattaaataacttgtcatcgtctgttcttccaattttccataacctctcaggaacaagctgccctgcatcagatctgctgacaaaatcatcctttcggattataaacgcccgtttcagtgactctgctaacacagaaatatttcttttgataatccagtgattatttccataataggctttatttttttcaaactgcagctgagaaaaacggtattgattattttttatcacagggttctgtaaaattccatctgtaagatacaggatacagtttttgtggattcctgtacaaaatttccggttgactctggcctgctccgattcacttagatacgattttccgtaattcagttccacatattcccgtatccgtcgcactgactgtggatttatattctccgagctttccggaacttcttcattttccggagagaaataaaatctttttttctttttgtttctgatatccagactcatcatcttttttttgagattagaaagatatttttgaatgatgtcttccatctgttcatccgtcatacattcctgccacgcgtcattggccaatgccatatccggtaaattcagaatcttctccagatttccattccttttttcaaaagagggatccagaacatgattataaatctcctctataacgtttatgacatcttccgtattttccgcatccttcagagaaagaattttgtacaatgcaatctctgcctgtggatccgttccctcatcgtttgtgttctccagaacatgctttatatacagaagtctaatcctgtgaatcaggtctgttccagctttgtttgatacctgttctttctcggccttttccaattctctgaacgcctgttctctgattttctttgttcccaaacgttctcgaatgataaaacgattcactgcagcatccatgcataatccagcaagaggcaaaagcatatcttctccagcagaaaaatgtaattttttcatcaaatacatgccaagtttcttctgatcaaaatatcgtgcaaaggccccctgctttactgcctcatataaaaccgtttgttttgaataaacatatttttctgtgtccggttcaaattctatatcataatcaccactgactgtccaaaaaagatttctgatacgattactaatctccagacgatgttcttccagttgttctgccgaccatctgacatcctccatacaaatttacccccatatgtcttttccggtccaggaagatggaattctggtagaaaccacatcttctacgatctctttttcaaatacatcaaaacttttatttatgatccccatctggattgcatcaattggagaaagtccgcttcttgttgcttttacagcagaaaccaatcctctcaggtcaagagattttgttgagatttctccatgataagccttgatctgcaaatccagaaacagtcctgcaaaagctttcagtgcgcttttttccccatctggaaaatgctgtcttaatacaaaaaggacactatcctcatccatttcaggcatatcaattaccataaaccttgaaaccaatgcttcatttaactctctggtacctgcgtaaccataattcatcgtaccgataaatcgtgttgccggatgaagtaaaatcctgttatatcctggaatatcgattctgcgccgatgatccaatgtggcatgcagtacagaaacggcatcattttttgccatattgatttcgtccaggattccaaatcctccaaattccgcacattggtagatggggcctttccgaaggcaaacctcattatttataaaggtatccgttccaatcagatcggcactgtctgtatttacatgaaaagaaatgtcgtattccggtcttccgaatatccatgccagtgtctcacatagtacatttttccctgtagctttcgcaccggaaagtaacaggttatctccctgaagaagcgctactattgacatttccagaatctttttcccataaaataggatatccggtttttctacccgttcctttacctgctcctctacctcataacgcatgtgaaaatctctcagctctccaatcaattcctgcgctatcttctggtcttctaaatatttttctatttctgtccaatgatttctcatgaagattttcctttctttgcaattggttataccaaatcagataatatttctgtttactcaaaattgtatccagtaagcagcgctgattctgtactttttccacagccacctttgccacatactgtaatcttcataccttcaatcctccaactcacagtcctagcttctttacaatttctcccagtgcacttcttacaggagaatctttcggaagccgtatgatcggctttccatcacagtcatactgatatacctggtcatcatgtggtacaacccctaacagttccagtccctgatttcggatttcttccagagttccggcatccagttttccatctggaacacgattcacgatcaatcctgttttctgtggtttaaaattcaattccttcatcagctttgcaatacgtccggctgcctgaacacctcttctggaacagtcactcacaagaatcgcaacttccatcattggcaggatgcctctgctgatgtgttccatacctgcttcgttatcaaccacaatatatggataatggctttgcagtttctgaacctgggtctgtacaagaccatttacaaaacaataacagccctgtccctgggttctccccattaccatcaaatcataatcatcttcttctgcaattgcatcggaaagacgcatttccagatatgcctgttttgtcataccggacgggatctgatatcgtgggtcgacacctgcccgctcaatttcttctctcaattctccaagtttgatttccggctccacaccaagtacttcatttagattggcattcgcatctgcatctacggccagaaccggacgtttcccactttcgcacaaatactggatcaataatccacaaagggtagtttttcctacgccgccttttcctgatactgcaattacatgtcccatatttttcctcctaaaattctaaacaatctgttgactttttctttaaaccccattatagttgttactatataaattacaataaccaatctatgaaatctgttctgttcctcaacatatcccaaaaactgttgagaaatgatacattgtaaagcatacattcaatggaggtcattatgtcggaaaaaacaaaaaagcaggatcgccgtaccagatataccaaacaagctataaaagaaacttttttagaattattaaagcagaaaaatttcacaaaaatcacggtcactgaaatctgtaaaatttctgaaataaacagaggtactttttatctgcattattacgatatccatgacgtgttggaagatattttaaatgatatcgcacaggatatgaaaacaactgtagaacatttattttgcccaaaccaaaaaagctgttcctatcccttctgccaaaagattcaaacagaaacaaaatacagatctctgtttctggatgatacgattgctcccattcttctggaaaaaatagcagaaaatacaaaagaaggctatgtgacctggcttatgtcacacagccttctgacctttgagcaggcagaatcggttttttattttcaaatgaatggctgcctttctatcaacagactgatgctccgcaatcactgtaatgactggcaacagattcagacaacaattgacaaatttatcaaagccggactggaaagttttctgattcatgatcagaggcaagaaaatgcttccgataatttttgcagcaaaacttccccaactgttactgcatcttctacactcagataatgatccgcatgatcctgaagaaatattttgccagatacaggaaattcttcatctgcaaaccatacctttaaagttactgaatatcttggaaaaactggaaaaacagcacataaatccgcctttgtctctataaattctgcacccagacttgtacatgctttctgaattttctcaggatctttatcctgcaaaagcttttccagtttctgctctgcagttcggtcaaacctggttccccgaatcaatccatctttcaggttaccaaaagtaatgagcttctgtgagccttctgtgccatcggccatatccagataatgcagcaatatcagataatgccattcatccatatctgagttaatatggaatccaggaagttgaatttcaatcgtttcataaaaactcagtatctcaattgtatttcggctgctatgaaaaacagccccgctttttgcagcaatctcctctcctgaacgattttgtaaccgttttactgctacctgaaacatttcctgaaatgcacgattttctgtttgatttttgtattccataaattctcctttgtaaatattttatcgcatcatataataatcaatgtttatctactatagagcagataaatttccttttaacttgtctacaatcaacatattatacaatcctccataagtttcattcctgtgttgacttttcctttaaatttcattatagttgtaattatattatttacaataacccaaataaaaaaaggagtttcttatcatgaaatattcaacgaaattaagcgatactgttcatgtgatggttctgattgctatcaaccaggaaaaatctctctccagtacctcaattgcagaaagtgtccatacaaatcccggctttgtacgccagcttatgttaaaactaaaaaaagccggacttatgaccagtgtagccggacatgctcgtccttctctttcaaaaccagcagaccagattacattgctggatatttataaagcagttgaaggtgagaagccgctgcttcatttagatactcataccaaccctgattgcggcgttggcattaatattcagttgtctttgcagggattctataatgaaatccaaaaaactgctgaagaaaaaatgaatacaattactttacaggatatcataaatacctattatcagcgaacatccatgcacaatgatttacaaaacattatatgacaagagaatattcttatgtaccttcagcagatacgaaataccaccatttttttatgttatggtggcaaaagatttttaattgatcctgtattagtaccaaaaggaagctgacctccttttcctaattcgattcgtcaggttcaaaacaatccactggtggatcttccctttcccattaattaacgtttaaaagccgatgcatatattattacacatctgcatacagatcactttgatgaatgggcacaacaaatcaaaaactatcccttaccagattttccactttgcgatattcacttttttcttctaaacggattactatattatttttcatgatcggattcagtaagcaggtccagccacgagatactgctgatataacttctgcatctctttactgcgaaattgctctattgtcagcatcttccgaaacgatgacgcaatatcatcctatgtccagtattcaaatacattgtttaatattccttttctatctcgctatctattccatacattttcttgaacgcatcaaggtctgcctggttcttaatcagtataacctcttctatcttacctgtatgaatgtctttaaacccaactacttgctcgccattacatatgctcgctttgattactggtttcttattttctttatcatatgtctttgtaactgcctttttcttaaatagacccactctaagcaccttcttttgactttgccatcagtataagtttttcaaaggactgtgcaaagcatacaccatcttcttctgtacgctttcccggttctttcatctatattcttatgagcgttgtttcacatatttgatttgcctgtgttccattcttctcatctgaatcgacatttccatttctgccaagaacatgatcaaactcatcaagaatatccagcattaagccttcatcaatccgacttctacactctgcagcaatactgcctgaattccataagatcatacaagcctttgggagcaatctccactttttactttccatttatcactgttcaatgacctgcatttcggtaccccccccccgccggattttatgcttctgatcgtcttttccaataccttcatctcaaccggttttgaaacatgggcattcataccggctgccagagaatgctgaatatcctcagaaaacgcattggcggtcatagcaatgatcggaattgtcattgccagttcatgagaacttctgcggattgcttttgttgcctcataaccgttcatgacaggcatctgcacatccatcaggatcatgtcataatcccccggggcagactgttcaaatgtctccagaactctttcaccattttcacagatgatgcactctgcaccctcaatttttaacagttccatcaaaatctctgcattcagctcattatcctccgcacacaggaatctcattccctgaaggatattatcatcctgttcatctatttcttcttgtgctgccaaagcaattgttctctcctctgcaattctcatatctatgagaacctcaaaacagcttccttgtcccagtttactctccaaatcaatggtgcctcccattgctttaaccagatttctggtaatagccattccgagaccggttccctgtatcttattagtcatagaactttcagcgcgggtaaacggatcaaaaatcgtctctttgaaatctgcagacattcccataccattatcgctgactaagaaacggtactttgcatagacagatgactttgtctcacattcttctaccagaaactgaatttttccaccttcctgcgtgtacttcactgcattagaaagcaagttgctgaaaatctgcatcagatgaacctgatctccgttcacccattcatgccggatgttttcttttatgatcgtaagagtctgttttttttcatctatctgtgactgaaataaagtattgatttcctgtataaaattcagaatggaaaaatcattgtatttaaaaactgtttttcctgcttcaatcttactcatatccagaacatcattaataatccctaacagatgctgtgatgaaatatctattttatctgcatactctattactttatctttattccctgcatcatatctgattaatgatgtcataccaataattgcattcattggtgtacgaatatcatgtgacatattggacaggaaatctgttttcgccttatttgcattttcagcggtctgcaaggcttccgttgtaatgtcctttgcttttttcagttttttattggactcctccatttccttcattgcctgcgtctgaatctcattatttcttttttcatattcagctttttgctcagcaagactgcgtctagaaatactgtagaataatccggcaaaaagcaaaagtataaaacctgccatgagtattgtttcaaacactattgttttctgataatctttcagtacattatctacaacactcttttctacaatacagatcagcatggtgttattattttctatcggacagtatcccagatagtaaggtttgtcacttcccagaagttctaccccctgttctctgccatccagctttttttgaagagaatcagcctcttcctcagtgatagcctgatctccttttaaatgctttaacaaaaaatagttcctaaaaaatttatcttctatctgatttgtataagtaatatttccgtcgttatccagcataaacagatacgcattcccgttatagcttttcacacttaacatggaatctaattttgaatgatcatacaaggttccaattgccgtataagtttccccattaatcgtatattcctgacatggaattgcaaccagataaccatcttttttcttctggttataatcaagagaaaccaattttccaatattatatccgttcctcaaatccaacaaacatttacttggcatgtcaacccgaagttttgttccatcagtggttattgcctttccattttcctggagaaatagaagtgtactttcagattctttctgccatgcctcaaagaacttcttgtttctatccagttcaatagatctcacttcctcttgaataagagaatcctcaagcaaatgcagctggctgtagtatccattcacctgcagatcataggtctgctgtatctgttcaacaacagctcccatactgcttttcccgttttccgtgatatagctgttcatcctgttcaaaaggaactttacaaaaattaagcttaaaaagataagaattaaaaagaacaatggcattataatcttttttctttttgttattacttgttctattcccacttttatttttcaacctctatataatcttccggtactgacggctgctgtccgtttgccattgctacggtccatgcacttgataatgttgtgttcccaagctgcctgatctcacattccagatttatttttttcaaaacagacattgtggtttctgtaagaagaatagagtactccttgtctttgtctatttttttcttatttacttctatgtcctttaatgagaatccgttttcctcctgcctgacgattattttcataccggatgcaattggcaattcgtatttattggttatgtgaaatttctcatcggactcagcaagatatttctccgcaagttcataaatttctttgccattgatttttgccaggtataaaaatgtatctgaactctttgccgtcatcaaagcaactcggctgccggtgcactctcctttgtaaatggaagaagtaaaataataatatggcaccagagccagctgcgcatcattttcttctctgatcgtagttaaaatagaagatgccgcatcgcgaccgtttttatcatttagcgaaatggcatattcgttttcaaaattaactgtggtttcttcttttgaatccttgctgttcattgtgctgcgaaaagtatcataagcctgtgtttcatccatttcccctgacaataatccgtgaacagccttaaggctggcatcaaatgatttttgagcagaatatcggatataaacagaattattattaatttcatcttcaaggccaggtacatcttccatcatgtttggaacatctacatttaatgaaattacaccctttccatctgcgatcagcgtttgtccttcttttgaaatcatacactccaggacatcgaatgccagatccagtttttcctgatctttttccaggtctttgttgaatgcaatattcagagaaggggtcatatttataaaagcttcatccgaaatctgtgaaaaaaacggtatacgagttaattctgcatccatctgttcctgatattcctgcataagtgccggataaccatgaaacattgctgcttttccctcaaggaacatctgcgctgcagtattaagatcgacgctgatatcatcacttgtaaaatgtgagtctttcaaaaatgtattggtttctgaaaaaatacgtttccataacgcatcatcaaacgcgatatcccctgatgcactttcagctgaacttctccattcgattccatccagactcatgaattcaccgattgcacctgtctgaatcacctcatgagtggaccagtcttctgcaagatccagggaatacggttttataccattatcataaaattgctggcatgcctgtgcatattccttatagtttttcggtatcttgattccatactgttcaaacaatgtcttgttggcaataatcgtctgcggtataccgcagataggaagccactgaatctcattttttgaatttttataatattgcaatgcataggagtaatacctggaaaccacatcataagaagcaaaatccattagatatggctccagatcctgtgcatcttttccagaaaatcgacgtacggttatgatatccggcagttcaccatgttcctcaaaatagctatataaatcggtatcattgttaccggtaataaactcaatatcctgatctggaaacttctcatggatatagggtacaatatttttcattaaacgattttcccacagatacacggtaaggtgatcgtcatttttagatactgcttttttagattgtccacagccagacaaaacagtagctactacaagcacccctgacaataaagctatcagataatgttttgcctttttcatactcttattttcctcattctttcctgataaaaaccataattcaataatcccatctcagactttcatcttatttgccgattattctattataacttgtaaagcggatgtttgcaatccgcttcgctacttgctcatgcaaaaatattaatgctattatacctctctctactttttcagaagcttttcccatgcatctggaaggcaattacagccagttttccagaacatcattcaacttattcatatccagcggtttcgcgatatgtccattcatgcctgtatttttggcaagctgtacgtcttctgcaaaagcattggcagtcatggcaacaataggcagttttcccttttcacccggaaggctcctgattgccgctgttgcctcataaccattcataacaggcatttggatatccataaaaataagatcatacgaacctttcggagaagcctccactttctcaactgcaattttcccattttctgccgtttccacttttgcacctgtcatctgcaagatttcaccagcaatttctctgttcaactcattatcctcaaccagcagaatcctttttcccgtgtagtctgattctgacagcttctccaaataatttcttgcgccacagaaatacgttcatcacaagaaaaaatgagcagaaaatcccatccgactcgtcgagggcactgaaaaactgtttttacatacaatatatagtagtgtaaaacatataagtatgctttaccttgtaccgttttgtgtaaaataaggactttttcagtggtgtcgactcgtcggatggggttttctgctctataatagataaaagtatacagagatgtattatttaataggaacaaaatggaatgtaaaaaaatattttttgcttcactaatgctctgtataccaaaaagaaactgtctcactaagcaattagcagacagtttctttttttattggtaatgtatatgtgtagctgatactgcgattttcacattttttgcgtaaacttcgctgaagcagcttacgctttcttttacgcaagtttatacgcaaatttgacacaaaatcacataatactttacggtaaaatatgataagttatgatacttacgcttttttcaaaaactacagtacagagttcacaacacctgattttatagggttttcagtcttttttcaaaaaagttcgctgatgtacttagtttcccatctgttttgcaacttcttctgcaaagttttcttctttcttttcgataccttctccagtttcgaaacgaacgaatcctttcacagcaattttagcgccgttttctttagcaacctgttctacgtatttagctacagactgttttccatcttctgcttttacgtatacctgatctaacagacagatttctttcatttcttttttgatacgtccggcaatcattccctggattactttttctggtttctgagattctttcgggtcattctgaatctgagccataaggatttctttttcatgagcgatgaaatctgcacttacttcgctttcatctgtgtattttggatttaaagctgcaatctgcattgctacgtttttagccatttctttaacagcgtcgtttacaacatctgtttcaacatcaacaagaacgccgatttttccgcccatgtgtgtgtaagaagctacaaatccgtttgcttcttcaactttagcgaatcttctgatgttcatgttttcaccgattactgcaatctgagctgctaaagcttcgtttacagtcttagttgtatcaaatttccatgtttcagcaaggaacgcttctacgtcagcagcttctgtttccataacctgttctgcaacctgtgcaacatatccctggaatttgtcgtttttagcaacgaagtctgtttctgcattaacttctacaacaactgctttctttccatcttctgatacgagagttttgcaaagaccttcagctgcaacacggctagcttttttctgagcagtagcaagacctttttctcttaaaaattctactgctttatccatatcgccttctgtagctgtaagagctttcttacaatccatcataccagcgcctgtcatttctcttaattcttttaccattcctgctgtaatagccatcgtgatagtcctcctgaatttataattattttaaaatttttccgttttattctttattaagaaaccgccctggttaaaaagccagggcgttatgaatcattgcccataaagatggggaaattattcttctactgtttcttctgcttcttcaacgaattctacatcttctgctgttccctggtttgcttcgattacagcgtctgccattttagaaacaatcagttttacggctctaattgcatcatcgttacctggaattacataatccagttcttctgggtcacagtttgtatctgcgataccgataagcggaatacccagtgtatgagcttcctgaacacagattctttcttttttcgggtctacgataaagatagcatctggaagttttttcatttctttgataccgccaaggtttttctgtaacttagccatttcttttttcagttcgattacttcttttttcggaagtacatcaaatgttccatcagcttccatagcttcgatttcttttaattttgcaattctgctctggattgttttgaagtttgtgagcataccacctaaccatctttcgtttacgtagtacattccgcaacgttcagcttctgttttgatagcatcctgagcctgttttttagttcctacgaagaggattgtgccgccttcagcagcgatatcagcaactgctttataagcatcgtcaaccattcctacagatttctgcaggtcgatgatatagataccatttctttctgtgtagatgtatggagccattttagggttccatcttctggtctgatgtccgaaatgaacacctgcttccagtaactgtttcattgaaataacgctcattttcttatctcctttggttgttttcttccgcttatttctactcttttggaacttttttatataaaaaagcaccttccatcagaattcataagcgtggttatttttttgcaacactggcattatatcatagataaatatcgtaatcaagccatttttttgtttttttcgcacattctgtgcagccagcttttcaaaagaggcatccagctttgacactctttctgaattccacttccatctgctcttcgtaatgtttcatccgcaagcgagagtccatgctccccttctggatacagatgatattctaccggaacttttgcttttcccattgcttcaacaaaaaacatggaattttgaaacggaactgttttatcctcaaacgtatgccataaaaaagcgggcggaacttgttctcctacctgagtttccagcgccatctcttctttcttttcctcgtaagtatcccccaacagattatgtatactctccaagtgggtatactcttcttttgacgtaatcaccggatagcataaaattaatcctgacacttttagctcttctgtcttgacccctgttttctctgccacaaacggacgattccagaatactccataacttgccgcaagatgtccacccgctgaaaatcccatcacaaacactttttccgtgtcaatatgccactcttctgccttttcttttaaaagtttgattgattcagctacttctaacaatgctgttggaaaaattgccggtgcgcaggaataacgtagcacagcagcatggtatccagcactgtttaaatgcagcgcaatcatttctgcttctctgtctgctgtaaaccgataagctcctcccgggcagattaaaaccagcggtcgctttaaattcggttctaattcttcataagaatctaaaatataagtcgtcaaatgagaatcttttaaagaaccttctgcctttatggaaatatttttatgtatcataattctgtcctctttctctgttttatgtactctcggaatcattctctgtgcaaatgctgaaaattccttaagaatccttttttcttgttattctttctcaataatcgtaccacttcgatacgctgccaataatgctttcaattcttcaatattttcttttaatttccgaccattgtctgtatcttccaccgtttttcgtatcatggaacgctttaccaaaatactgtccgataaaatgtctgtctctctggtaattgcatcttctgctgacgtaaatggttcatgtgcagccagaatcattccccaggaattataaatcagcgtataacctgcaattccagtttctttttgatatgctttggaaaagcctccatcaataacaagcacttttccattacatttgattgggctttcgcctgctgcatgatgcaccggtacatgtccatttacaatatgcgcacagccttcttctaacccaaactcccgcataattcgattgattaccgtttcatcttctaacaatctgtaatatggatttttcttttcttcatgagtttctttttccgcaagaaaataccgttcaaaagttgccatcttctgtttgccaaaaagtggagaaccaggactactccagataaaccacaaaatatcttttcctttttctctctcattctcatcaattgcaacaaatgcttttctgacataagcctctaatacttcataaagtgcttttcccttgtattttttcccataaatgtctactgctttaaagcttccgtcctcatttaacggaatgcatccgtgatacagcagattattattataaaccttataaaggcttcccttctttaaaagtagattcatatggcgctgtaatttttcacagtttgtaaatgcagaagtcaatcgttccacaaccaacgtttcttcacttgacaattcatacggattatccgggtcaattgtagggaaattagagtccagtaatttatactcttttccatccaaccgaatggttccatttgcataatcaatactgtcaagcaatgcacgattcgccatatgaaattcttttcttctcatcaaaagctgtccctcaagcttaaattgaataaccgaaatggctttatgcatcttcatctgcagagaaatctctgccgggtttaaatcatttccgcctttaattttaaaacaactgcaagggtcatctttataatgaatcagagaaaatgtcgcaagcggaagcagattaattccatatccgtcttccaaaatatcaagatttgcatatcttgcacagattcggattacatttgcaatacaggttgtctgtccggctgctgctcccatccatacaatgtcatgatttccccactgaatatcaagcgaatggtaccgctcaagtttgttcataatttcatgcggtcccggtcctctgtcataaatatcaccaagaatgtgcatgtggtctacaaccagacgctgaatcacttctgaaagtgcaataataaaaacttccgctcttcctattgtaataattgtctctataatctgctcataataagcctctttatccgttagatctgatttttccgtaatcagttcctcaatcacataagcaaagtcaggtggtaacgcttttcgtacttttgaccgcgtatatttcgatgcggcctccttacagacttcaatcaaacgatacaatgtaattttataccagtccataatatcttcttcggtctttttgattaattccattttttcttttggataataaatcaaagtagcaagggagcgcttgtcctgttcatttaatgtatgcccgaacacgtcattaatttttcttcgtaccgaacccgaaccattttttaatacatgcgaaaatgcctcatactccccatgtatatcggtaagaaaatgttccgttccttttgggagatttaaaatcgcctgcagattaataatctccgtggatgcctttgcaattgtcgggtaaagctgtgacagtctttccagatactttaattccaacttttccataaatccctcctgatttttgtctttttcaccatgttttcattgtaacatactttcttttttatgaaaaccgccgaaatcaaaaaagatatccgaatcatcgttataaaacgactcggatatctcttttattacattctttccggtgcttcaaaaccaagtaaatcaatacaggtttctaatacatcacggcataatactaacagacgaatccaggatttcttctgttcttcattagattcgctaagaattttagtttcatgataaaagctgttaaatgcatttgccaaatcataaatataagaacaaatcttatgtggtgctttctcttcaaatgccggtgcaatgacagagttaaatttactaagttctaacatcagattcttttcactgtcatttactgcttctaagattgttccttcgttcggatttttgccttcctgcatatatttttccaaaatagatttaattcttacgattgtatacaagatatatggaccggtatttccttcaaaagaagtaaatctctctacatcaaagatataatctttagatgcctgattggataaatctccgtatttaattgctgcaagtcctaccatctcagcagttttttgcgcattttcatctttcacactgcggttttctacgatttttttatacatttcatcgttaatttctgcaatcagacgttccagacgcatgactccgccttctcttgtcttaaatggttttccgtcctttccgttcatcgtaccaaatccaacaaacgaaagagctgttttttcttctaccatttttgctttctttgcacaacggaatacctgtacaaaatgaagttcctgacgtttatctacaacataaataatttcatccggatgataatcttcttcacgctgtacgatggttgcaaggtccgttgtattgtaaagggaagctccgtctgattttaaaatcatacatggaggaatttcttttgtatcactctcttcttttacatctaccactaaagcgccctggtctacataagcataattatttttctttaagtagtctaccatatccggaatatatctgtctgcatcggattcacccatccataagtcaaaatccacatgcagtttggaataatttttcttcaagtcttctacggacactttcataatatggttccataatgcacggtatccgcgttttccctgctgaagctgtaatgttgcctctaacgcttcatttttgtatgcttcgtcttcttttgattttgcactggctgccggataaatctcttctaattcacttactgtaaacggtgcttcttctggatagtctccttcaaagctgtcatcaaaataaaccaattccggagaacgcttcttaagttctgtgatgatcaatcccatctgaagtccccagtctcctaaatgaacatctccgattactttatgacctaaaaaacgacccattctcttaatactctcaccgataattgcggaacgaagatgtccaacatgcagaggttttgctacatttggtccgccataatcgataataatcgtctttggtgctttttctttttcaatagataaattttcatctgcctgcatttcatttaagaactttgttaaaaatgccgacgcaatctttaaattgataaatccaggattgactgcttctgccatagaaaacagttcattctcttttaaaaatgcaaccacatcatttgcaatcataatcggcgcttttttataagtttttgcagctgccatcgctccattacactgatactcacataagtctggacgattggaaacatttactcttgcaaacttttcctcataacctgctttggtaaatgcttcttttactgcatcttccattaattccattattcttttcatcgttttttactccacttctaccttttttgagactgctactgcaagcgcaccctgtccgatatggcaggcaacacttaaagaaagcgggtccatgtgtatttccattcccggaaattctttttccagttcttttttccattcttctgcttcttccagatttcctgtataagcggcttccagacacatcagaccttttttattatattctttaaagcgttttttgaggtcttcctccatcgcttttatcataattttcttcgcctgttttttccctcttgctttcgcaaatgcatccagtttttcaccttgaatctgaagcaccggttttaattttaataccgttccaagtgcagcagcggccggtgtaattcttccacccttttttaaatattttaaagtctcaagtgtaatatagatactggattctgatttttctgcctccaggatttcttttacttgcgctcctgtctttcctgcctgaattaacgtcaaggcatctaaaacggactggcgctgtgttactgagattctttgattatctactacatgaacacgaccattaaattcgcgtgacagcacaaatgcagtctgacaggaattactcaaaccactggacattggaatatgtaccacttcctcatggtctgcaagcaatttttcccaagtttccattacatctgccggtgacggctgtgatgttgaaatatttgcatcttcttccagctttttataaaactcttcctgtgtcagggtaatcccctccaagaataactgttcattaatataaaacggcataggaagaacagtgacacctaattccttggcctgttgctgggtaataccgctgttgctatcggttacaactgcgatttttgtattttccattttttctaaactcctttgccaaataaggttacttctttttatgatagcatagactttgcttaaatacaatgcggatttttaaaaaaccggttgactgcatcctcagccagccggattttttatcaaattaactctaatcactcaaatttaattcattcttcttagtgcttcaattggacttaaatttgccgctttaattgacggaagcagtccaaatatcagtccgattgccatagaaaacaatacggatattaaaactgccggcacactgataacaagaggggtctgtgaaatcgtggaaatgatttttgccagaatcattcctgcaaacactcctaaaattcccccaatactcgtcaataccgccgcttctgtcaaaaactgtgctaaaattctccgcttatttgcaccgattgcttttttcagcccaatctcacccgttctttctgtcacagacaccagcataatattcataacgccaatgcctcctaccaaaagtgaaatgcttgcaatccagattaactgtcggtttgtattttcgctaatttgctgtaatccttttgccttttccataatatcttctgctttataggaaaccgaagtttcggtattttgaatctgctcatttaagatctgctgaacagcttttcctgcctgactcatatcttccggtgtttttgtctgaatgaccgcctgctgaggttcatcgtattgatataccactggccagacactgtctgtaatcattacaattccactttcatcattgtaataagtataatattcctcaatgctgttaatgaccggctcatattcatctgttttctttacaactccgacaacaacaaacggctcacctttaatttctatcgtcttccccagttcttcccctttttcaaaaaaactatttgctgctgtttcatcaagcagagctactttcttgaagttcgcatactctttttgattaaaacctctgcctcgaactaactgatacccacaggtatccagataatccgaatcaattccaagcacttttccgccgtccatgcttttatcttgataataaatgccatccgcataatctctcattctataaaagctggcactaactacttccggaatttctaaaatttcctctttctggctctcatttagtaccggcacaccttgtggaagtccttcatactcaatctgataatcacttcccccttcttttaacttaatttcaactacattgtctccatcaccgattaaattctttttaatctgctcattcgtccctttaattgtggagacaattgaaataattgaagcaattccgataataataccaagcatggtcagaaaggaacgcatcttatgtgcccagattccctgaaaagctaaacgtatattttcaatcatcccaaacctccatacatgttatatgcatcttctgctgaagtttcttttacagatgccccctcttttacttttttgccataaggaaaggcgataaaatcttcctctgtaatccctgatttgatttctaccattccataaaagatttttccggtctttaccggctgttttaccagttttccattttcttctttgtaaacaaaatcttccccgtctttttcccgcacatattctctgttcaaatagattcccgatgcatccatttcttctgccggaagttccatactgactgattcctgatttttcaacccctggacatcctgaatataagcagtaaaagaataatacgaaagggcactgttattactgttgctataattcgaggaaacaggataagttgaaatctcttttacttctgcctcaaatgaaacaccggattcatatgcagttccgcttatctgactgcccacttttaatttttctctttgatattcatccaccattccttttacataaataccctgtgtgctttggatttcaagaaatgcctctccgtctgtctgccctttgtctttgtccccgacttttttcaccacaccattgatggtactttttacttcctgattttccaattccttttcaatctgtgcaattttcaaatcactgcttttaatatctaattttacggtacggatttctgcatttgtctctgtaattgccttttctttttcttcttttgtataaccatcaattatagtttcctgcggaactgcctcagtaaattccatattctctaaaaattcatccgatggattttgtatttcttcatccggattttcatccggattccatttattgtattggtcttgttcttcggaattatcggctttattattggctttgttatcatccggtttatccgttttatcttctccctgattcttgttattatctaaaaccacatcatattttccaagacttgttttataccattttccagcttctaatggttctttgattttttctccatttaagtaaatcgctgccaaaagcactccatctggcttatctcctgttctgacttccaaaatacaatgcttcgctgctttttcttctgtctcatcctttgttgtaaaccctgccaattggttcaaaaaagctccctgtaccagaactccctctttacagagataacgatatggttcttcttttgtcccatcacctttatatggttttgcattttctgtttttccattcggacgactctctaacgtaatatcaccatagagtttttcgtaaacttctgcttctgtttccgatggttctggagtgtcaggtttctctggcgtttcaggtttttctggattctccggtttgtccggattttccggtgtctctggattttctggtttgtctgggttatccggattctccgactgatctggattttctacttctcccaaatttcctgactgttccggattctccggctgatttgatggttcttctgcccactctgaattatctgaatgactcaaaaaagtcagctgatactctgtatttaatgccgtattggtcactttctttttcttgatttttgccagtgtatcttccagcccttttttcttaatttgaagctgctggttgtttagtttttcagtctccaagttaatatgaaccagtgtcatatcgtaagaaagaagcggtgttccctctttcacttcctgtccctcctgtacgaaaacctcctgtacaatctgattttctgaaagctggactttctgtgagacatttgaagtaataattccttctaaagaactgctctctccccaaatcatctgcttgagttcttctactcgataaacttctacctttgtccggttaaatttttgaaccccaaaccagatgcccgtaccaatgactgtgacagatgccactataatcagcgcaagtttgatttttttatgcataaagtctcccctttactcctcactctctgtttctgaaatttcttctgattcttccattttccctgtatcatctgtactttcttcatcagatatcgtctcactttcctcatgagttgctttcataccctcttctaagaaatcctgcggaaatgcaatataatcactttcttctaatccggactgaatctcatattgataggtttcttcattatattctcccagtgttacatttcgcttttccagttttcctttattatcttccgtccaaacataaggtttactgtccgcatttacaatgtacccctcatccagccagattccactttgttcttctccaagatccttttcaatgtaaacatgctgtcctaacagcagtccgtctgaactgtccagcattacataaaaagaatacgaactcgacgtagtctctgtggatgttgctccatagtacatgttattgttattattttctgcttcatctgtattcactgccgtaaatgttccactccaggtctggttttcatccactctggaacgaactattgccttttccccttcctgaatctcagataaattctgttcatttacctttcctttaatccggtaatctccggttgccagaatcgttataaatgcattggaatctgaactatacatatctgttttacttccgtcattgatgctctttacaattccatcaatttcacttactactgttgcatttgcaattttatcctgcttttgagaaatttctacctgttttgctttcttttcatactctgattttttcaaatctgtctgcgcagtctgaatctgcgtcgtataagaaaatttttcgtcctctgccgcttttttcttttctttttcaagctgggcaatctgcgtttttaaattttccatctctccatcaaaacgttctatttcaagctgagcttcttcaagttctgtctgcgtctgttctgtattataaacaaacaatgccgttccaacttttacttcatctccggcttttaccaaaatctgttccacttctctatcagaacttttctgtacttcccatgtttcctgtggttctaccgtccctgccatcctttgaacctgagaagccggattcataagggaaacctgatagacataagccagctctgtattgcttgtttctgtctttcttgttccaaaatacacacctgttccaattactgctattaaaatcagcccacctgctattgttagaattttcttttttcttgtcatagaagcctccttttttcattcatccggtataccatgagtataccagattttaaaacatctgtcttttattccaaacaagtttaatcttaagatgccttaagagattgaattgtttgacattttcgcaatttctggtaaacttaaagcatatcgcaaacttactaaaggagacaattttatgattcaattccagaataagcgacttttttttgcagcttttcttcttttcttttctgttctgcttaccggatgcgccagcaaagaagaaaaagccatcagacagaccatcagctcagaacttgaccatctggtatcaccagatgcaactcagataaatacttatttatcgttccagcttctgtttccagatgcacagcaggatgactcgtctgatttagacccttctatcacagaaatttttacagaattctataaaaacttttcttacaaaatttcggaagtttcatacgacgacaaatctgcctctgcagatgttatcattcacaatttggatacgcatgcccttgcaaaagactacgcaattgctgccttaaaaaagagaatcgagggtgacgcaaatccatcccaggtggacttttccttaagtgactcttatctgctgcttgacaagacgctcaaaaatcatgattataagcaggtagaatctgatattaaaatccaactaaaaaagaaaaacaatgtatgggaaattgtggaagataccgactttgataatgagctatccggaaattttcttacttatatgtctgattccaacctgctctctccaaaacaggttgtcaaaattcactttgataccatcaagaaatttgatgcagaacagctcaaccgttatctctcattagacagtctgcttaatacagacaatacttataccagttccatcgcacacgcactagctgaacagattcataaatctttcgactataagattaaaagtgactctgtagaaaataattctgcaaaagtagtggtaaaaattaccagtacagattttacaagcatccttgagacttaccagaaacagatttctgaatgggtacagtcttccgatgcccttgaagccggactgcttggacgccatgaaaaaggcagagagttcttgttaaaagcaatacaagacaatactgcaactacaagcgaaacggttgaaatttcgcttacaaacgacggaacaagctggaagatgcagatggatcagaatcttgcacaggcgattttaggcggggtcagcagtactcttgcagatgtacaggaagatgtagagtaaaaaaaataccgaagactgtcttttacgacaatctccggtatttttttatgtttttatttttcttccgttgtttcttccggtaaatctactttgatacacagttctttcaactgtttttcatctaccacattcggagcttctgacatcagacaggaagcatcttttactttcgggaaggcaataacctcacggatagaatcttcttttgccatcaacataaccatacggtctaacccataagccagtcctgcgtgcggaggcaccccatatttgaatgcatttaacaggaagccaaactgattgtaggcctgttctctggtaaatccaagtacttcaaacattttttcctgaatgtcattctggtggattctgacgcttcctccaccgatttcatttccgttcaggacaatatcgtaagcctttgcacgaactgcacccggatcactgtcaatcaaatgtaagtcttcttccatcggcattgtaaatggatgatgcattgctgtaaagcggttttcttcttcagaccactctaataatgggaactctgtaatccatacaaaacggtattcgttcttgtcaagtaaatccatctggcgtgccatttcaagacgaagtgcacctaatatatcccataccagtttggttttatcggctgcgaataacagtaagtctcctgcttcaccctgcatcttctcaacaagtgctttcatttcttcctctttcatgaatttactgaaagaagattttaaagtgccgtcttcatgaattgcgatataagcaagaccttttgcaccgtatccttttgcaaattcaaccaatttgtcaattttcttacgaggcatactgccctgtccttttgcattgattccacggacacttccacccatttccagagcactcttaaatacaacaaactcacagtcttttacaacatcagagacatctgtcagttccattccaaaacgtaaatccggtttatctgaaccaaaacggttcattgcttctttccaggtcattctctgaattggaagctgtacttctactccaagtacttctttaaacagatgagccagcatacgttcatttacatcgataacatcatctacatccacgaaagataattccatatcaatctgagtaaattccggctgacggtctgcacgtaagtcttcatcacggaaacattttgcaatctggaaataacggtcataaccagagcacattaaaagctgtttaaaaatctgaggagactgcggtaatgcatagaaacttcccggatgaatacggctcggtaccagataatctcttgcaccttccggtgtactcttatttaaaatcggagtttcaatctctaaaaatccctcatccgctaagaactgacgaaccagtactgctactttagaacgcagtatcagatttttttgaaggtctggtcttcttaaatcaagataacggtattttaaacgtacttcttctcttgtcttgctgttctcttcaattgggaacggcggtgtctcggattcagaaagtacacgaagagaattggcacggatttcaatttctcctgttgccagattttcattgacagcaccggaacgtgcttctacatgtccggttactgcaatgacaaattcacttcttaattttccggctttttcaaatccttctgcatcaatatctccattttcaaagataatctgcataataccggaacggtcacgaaggtctacaaagacaataccgcctttattacggctcttctgcacccagcccataagggttaccgtgcttccgatttctgcttttgtaacttccgcacatctgtgggttctctttaaccctttcattgattctgccattgtaattcttctcccttaaattcacttagagctttcgtacatcgtaaatgatgtattagttgccgaaattaatcgttataaatttcttcgatgatttcatagccttcggaaagaagctgctctttttggaattttttatttttcttcatatatacgatattaatatttttacctgcttttctttcttcaccggcttttttaacaacctctaccagtttagcagatgagagttttttgtcaagcagatatgcttttttatctgcgcttcccggaactttaaatcctttttccattaacagcataacgattctctcaaatccaatcgaaaatccggttgccggtgtcggtgttcctgtgaattttccaatcatttcatcatagcgtccgccaccgcctacacttcctgcaaatccatcaatactgatttcaaagattggtcctgtatagtaagacattccacgaaccagtgtcggatcaaatttaatttcaaagtttgctgtttttgcttctaatacactttcgataattgttgtcatattgtctgcaatttccggtgcaaggaagccttccaatttctctttgcagtaaagtactccatcgattccatcactgattttatcaaataaatcaatgtatttttcaatgctttcttttgcaaatccggattcttcaagttctgctgcaacaccgtctaaaccaattttatccattttatctaagataataaatacctgatcataagattcttctgcaaatccactgtaagcagccattgcttttaagaaacgtctgtcattgatacggatagtaaagctgtcgaagtccagttttcctaccagagtagaagttgcaaggataacatcaatttcagcaagattggtcggctcacctaaaatgtcgatatcacactgcataaactgacggaaacgtcctctctgcggtctgtctgcacggaatacatttccaatctgaagtgctttaaacggagatggcagctcatttgcattatttgaatagaaacggcaaagcggtacagtcaggtcataacgaagaccgctgtctactaaatcattttcttcttttgcttcactgatttttaatttttctccacgttttaagatacggaaaatcagtttttcattatctccaccctgtttgctggttaagttttcaatgtgttctacacaaggagtttccatagaagtaaaaccaaactgtttgtaagtctctttgattaatccgattaagtaatcacggatttccatctctcttggtaaaatgtctttcattcctgttactggttttttctttaactgcatatcactttctccttttctttctcttcctcatgcattgttctttgaaatgcaagaaatattttcatatcaaaatttttcacttcatcaatgagcatttccattgccacttccggcgaaaatgcatctcgatagcttctttttgacgtcaatgctgcatatacatcacaaattcttaaaattcttgcgccaagcggaatttcctctcctgataaatttttcggatatccactgccgtcatagttttcatgatgataataaatactttcgagtataaaatcagaatatcctctttcttttaaactctcataccctaacttgggatgctttctgacatacttgatttcctctacaataagaggtttttcttcagccgtaatataatttctaagctttaattttccaatatcatgcagaatccctgcaaccgcaagctcatgacacattgtctcttccagaccaagcatttttccggttcgatatgccagattacttacctgtattccatgtttgatttctttttccagatcaaacgtaatcaaatgcatcaatggttcagatgaagcctcttgtattgcttcactcatcctgtgcacttcctatctccagatatttctttaatccacttcttttacgctcaatcatttcgtcaattctggaaatataattcgttacatcttttacattttctgcacgctcaatccgcgctccgtcttcaaaaacaaattttgtcgatgcacctgcacctgccgcaataatcgactgtttttcctccataatcagaatattataaattcctgccttatcctctttggcatacccgacattttcaagattaccggacatatttttctggcggtataaataatatggacccatgccacactctctggcacaattcattgccatatccataatctcctgattattttcaaaggacatctcctgatatcggtcttgaaacagatggagtctggttgcacgcttgattgccagtgaatgaacggtaagactgtccggctccatcttctttacttcttctaatgttttttgtacatctttggcgcactcacccggcagacctacaattaaatccatatttatattatcaaatccacattccctcgctaacgcgaaggcgtgtcgtgtatcctccaccgtatgtctgcgtccgattaaatccagcgttgcctgattcatcgtctgaggattcacagaaattcttgtaaccggatattttcgaatcacttcgagtttttctctggtaatactatccggacgtcctgcctctatggtgtattctttcacttcacgggtcgggaaacaacattcaatatgagaaagcaacctctctaactgttccggctctaaagtcgtaggtgttccacctccgatataaattgtatcaagtgtccgcactttcatggtctctccaatgtaagtcagctccttacaaagtgcatccagataggcgtctactttatctctccacttcgctaaaggataagagctaaacgaacaatagaggcaaatacttgggcaaaacggaattcccacataaagactatagccatttttataatcaatgtctgctaagagtgctcgttcccgatttgcaattgtaatcgccagtgctgtcttttcattactcgtataataagtatttctcataaactcagcggtttccacattgctcattccactttcaatcagtcccattgcaatctttgtcggacggattccggttaaatctccccatggaagcactttttttgtttcttttgaaagtccacgatacaatgcctgctttaacttattttttctctcttttcgctcatcatccgaagccaaaaaaatcgtttcctcaaacaccgtttctttatttttcaaaatttccagtctggtatcttccttgttataggtgattttcaccacaagaaaagcttcttctttttcttgaaaagtttctgttttttcctctccctcataaagaattgaaacctcttcctgaggataaaacgctttaatcagagtatacgcatcatactcaaattcttttttattaaatactatgtctatcatatagattcctcttttgatactttttatagataaggattatatgatttttcatgacgaatactggtttcatttccatgtcccggataaatttgtacttcctgcggaagatgatcaatgattttatgaagactaatctgcatctgcgcaaaacttcctcctggcaaatcgcatcttccacagtttccttcaaaaatagtatccccgctcatgagaagttcttcctcttcaaagtaataacaacaagaaccttctgtgtgtccaggagtcagatacatgcgaattttagatcctgcaagttctatctcctgtccatcttccaaatattcatctgcttctaccgtatatcctcttccttcccattcaagagaaagattaatttcaggattggaaagtgtctctttttctgcttttgatgcaaaaattggaattttccattcctgtcttaattcatttactgccatcatatggtcataatgtccatgagtcagtaaaattgcaactggtttttttcccagtttctcaatcattttgctaatgcgttctgcttctgcacccgggtctactaaaatcaactctgtcgtctctttgttttgcagaaaatagcagttcgtcataaccggtcctaccacaagtgacctgagatttaagttcttcatcgctttgctccttctctatctaacgtactcttggaatctttctatgttaatttcgcaaaaaaacatggaaaattccgagagtacatcctatcaaccggttgttcgttcaatatcttttacgctctctatctgtctgatttttgtaatcagactctggagctcttccttactctttacatcaaatgccagactgatggttgcaattccctgtttgcttgttctggtattaatcgatgaaatatcaatttttcgttctgtaaaaatttttgaaacatctacaatcaagccggtacggttatacgcataaatcgtaatctctgccgtatactgttcattttctccaccgcctgttgtactctcccattctgcttccatcagacgctggcgttcttctgctgacatatttaagacattgacacaatccgtacgatgaatcgtaacaccgcgtccacgtgtaacataagctacaatttcatctcccggaagcggattgcagcattttggataacgggcatttaaatcattcattccttttataataatcccgctttttcctttatgtggacgaatcttttctttattgttctctgatgctgcctctaatactttctcatcagtcagttctgccttatggtctttattatacagctctaacagcttatttaaaacctgaccttcttttaaaccgccatgtccaacggcagcaagtacggagtcccagtcacggaaaccatattttttcataacggcttccagatatttctgctttgtcagatttccaagagaaaaaccttttacttttgcatactggttcaacatctcttttccttttaagatattgtcctcttttctctcctgtttaaaccactgattaatcttatttttagcctgtgtactttttactacttttaaccagtcacgacttggaccttttgagttctgtgaagtgataatctcaattctgtctccatttttaatcacgtactcaatcggaaccaattttccattgacacgcgctccaaccattttatttccaactgcactatgtacattgtacgcaaaatcaatcggagttgagccatttggaagagtcttaacatctcctgccggtgtaaagcagtatacactttctgaaaataaatcaaggtcattttttaacagactcaaaaattctttattgtcagacatatctctctgccattccagaatctgacgcagccaactcatcttttcttcttcctgacgagttgtattttcctttccgccattattggaaacctctttatatttccagtgggcagcaataccatattctgctgttctgtgcatttcaaacgtacgaatctggatttcaaacggctgtcctttcggtccaatcaaagttgtatgaagcgactgatacatatttggttttggcattgcaatatagtctttaaaacgccccggaaccggtttatacatttcatgaataattccaagacaggcataacagtctctcacggtatctacgataatacgcactgcaaataaatcataaatctgatcgagtgttttatcctgattgaccatctttttatagatgctgaaaaaatgtttgacacgtccgtcaatctgtgcatgaattccagcattctcaatatgctgtcttacctcttttacaatctcgcccacaaaaagttctctttcactttttctgagattgattttttctaccaaatcataatacacatctggtttcagatattttaatgacaggtcatctaattctatttttacttttgaaataccaagacgctgtgcaatcggtgcatagatatccatggtttctctggctttttctttctgcttatgaggcggcatatatttcaatgttctcatattatgcagacggtccgccaatttaatcaaaataacacgaatatcttttgccatggcaagaaacatttttcttaaattttccgcctgcacttctatcttgtccgccgagtaactcaactgtcccagtttggttactccgtctaccaaaagagaaacctctgcactgaactcttcggtaatttcttcggttgtcataaccgtatcttcgacaacgtcatgcaaaagccctgcaacaatcgtctctttatccagctctaaatctgccagaataattgcaacacaaagcggatgaataatatagggttctcctgattttctcagctgtcccttatgcgcattatttgcaatctggtacgctttttctatcatggaaatatcagtagacggatggtacttctttacacttgaaatcagttccttatataaaatctccggactggtaaaatcttccatggttttgacgcttgcatctgcttttttaattttagcaatttcgtcgtcctgaagcgatgatgtatgatttttttccatatcttcgttcacctgatttctattttccctgatatttgataacagattccacgtcatatcctttcagacgttctcttccttttaatccttccagttccattaaaaagataacttttacgactgttccacctaattcttctaccaatttggcagctgcttcaatggttccccctgttgcaatcaaatcatctacaattactactttctgacctggcttaatagaatctttatgcatttcaatagttgcacttccatattccagatcataacttttttctactgtctcgcaaggaagctttcctttttttcttaccagaaccaacggtttatgtaagttatacgcgattggagctccaaaaataaatcctcttgattctgttcctacaataacatctgcatccgtatcttccaaaagtgcctgcatggaatctactgctaactttaatccatccgcatcctgcaaaatgcttgttacatctctgaaaataattccaggctccggaaaatccggaatacttcttacatattcttccagctttttcataattcgttcttccccgcttcctcttttatattttcgaatttgtcaatttaaatcgaatttttaaatgtgatatttagtataacatcttttcatttcgggatcaaatataattttgcacgataatttcgatagattcccgtccattgtatgtattaatagacggatagtaggcaattgaccaacgttctttctcctgaatttcatttacaaacgcttctccatctccaaaccagactccatccatgcagattccgtttttatcgtaaagcttcatttttactacgttcttattttttccaaaaattctgcactgtgtaatttttatatttttctctgcaaaaaccggcttattgtttccctttccaaatggctctaacaaagaaagctgacggatgagtggaagtgtcacataagaaatcggcatcggtacatcaattaaaactttttccatcatatcttcctgtgttaatgtgcattttttatttaacgccctacgaaatgcctcaatattttcttccggcagggaaagtcctgctgccatcggatgacctccaaacttagaaagcaaatctttacattttaccagttctttaaacatatgataagtttcaatcgagcgccccgaaccttttactccgtcttttccttttgtcaatacaatgactggtttgttatacgtctctcgaattcgtccggcaataattccggccagactttcatggcagtccggcagataaatgaccaacaccttgtcctcttttaactctgttgtctctaccagcttttcggcctgttccacacctttttgcgtcatttctttcctgctgtcatttagcgcttttaattcttctgccagttcctgcgctttttttgcatccttacaaagtaagagattcaacgctttttttgctgtacttaaccgtccgcttgcattaatacaaggacctaagacaaacccgatatgataaccggtcagttctgcctcttctaaatgattgacacgaattaaggctcttaaaccataattttttgtatttttcattcttctaagtccttcttttacaacaatgcggttttcatcctgcaaatccatcacgtcaccaaccgttgcaatcgctgcaaattcaataaactcttcctgcgcttcttttggaaatccttttttctcatacaaaccacaaatcagcttgtatgccaccattgccccgcaaattcctttaaacggatacagacacccttcctgctttggatttacaatcgcatccgcaggcggaagaattgttttgatactgccatcttcctgttcctcatatggaatctcgtgatgatcggtcacaatcactgtcattccaagactttttgcataggcaacctgttccatggcactaatcccgttgtcgcaggtaataatcgtatccgttccagcctgataagcaaggtcaattaattctttgctgattccatacccatccttgattcgatccggaatatcaatatctacgattgctcctgctttttttaagccaattaatagaatataagtcgagcatacgccgtcaatatcataatctccaatgattcgtatttttttcttttccccgattttttccagtaaaagctccagtgccttctccattcctttcatcaactgaaacgaataaatctgattcatccctccatgcagatactgttcaatttcttcttcacttatccgttccctgtttctaattacccttgcaatcactgggtcgactccaaatttcctgccgattccataaaaatctgccttttttgccaaaaccatccatttttgcatgtcatttctgtccttatcttcctgttttttcttctattatatatactataccacacttatacaatgatacaaataaaaaagagactgcttttaaacagtctcttcctcaatttttatttctttttcagttttgttctcatcacataccaaagtgctccggtaatgcatacagaagaatatccaccgcatacaatacctaccataagcggcattgcaaattcacgtacagaagagacaccgagaacaaacaggaagaataccatgataaaagtagtcagagaagtataaatacttcttgttaaggtctgggtaatactggtatttacaaccagttccaaatctttcttctttcctgctgcctttaagttttcacgaatacggtcgaaaataacgatagtcgcattaatggagtaaccaacaatggtcagcatacacgcaataaaggtagttcctacggatactcgtgcaatcgcatagaacgccagtacaaccagtacatcatgaatcagtgcaagtacagcgcttcctgcaaaacggatatctttaaagcggaaccagatatataacagcatcaaaattgttgcaatgatgactgcttttactgcatcggaacgcatttctttacttactgtagaagaaatactttcacttgtaattaaatcagggtctacatcaaagttttctaccagtgcattgtctaatttctctcttgtttctacatctaaagtaatagtcttgataattacctgattacttcccactacttttgtcgcctgaatatttttatcaccggttacttcttctacaaccggtgttactttggaatcaatttcctgaatggtcatatcttccttaaaggttacattcgtagaagtaccaccctgaaattccaggctgtattttaacgcacttcctgttgtcttaccaaagattatcatagctaccggtgcagaaagcactaagatcagagaaattataaagaaaattttcttttttgcaagaaaatgaatcggttctctttctttttttacaccatagaattttttatctctgactccgactgcgtaaactgcatacataacaaagcgtgatacaacaagtgcagtaaacatggataatacaataccaagtgccaatgtctgtgcaaatcctttcacagaacctgttccgagccagtttaatacaaatgctgcaatcaaggttgtaacattaccatctaagattgcagaaaaagccttctgaaatccgctcttaattgcagtctgaacgcttttaccggcgctgatttcctcctgaatacgtgcatagataataacatttgcatccactgccataccgattgaaagaataataccggctacacctggaagagtcagcgtcaaatcaaacgcatttaaacaaattaagtcaaggcaggtatagataatcagagctacaccggctacgacaccaggtacacgataaaccagaatcataaataagataactaaaatcagaccaattgcggctgcttttaaactggttgcgattgcttcttctccaagctgtgctgctactacattggaacgaagttcttttaattccagtttcagaccaccgatacggatggtagatgccagactttctgcttcttccgcatttttcattccggaaatctgagcttttccgtctttaatttccgcatttacactaggtacacttacgaactcaccatcataataaataccgatggaatcatggctgtcctcataagccgcctttgttgcttccgcaaatttatctgttccgtcttttgtcagtgttaaatcaacaacatttgtattatttttcaagtcatcctgcacgacctgtgcgcttgccgtttttacatctgttccggtcagcacaatcgaaccgtcttcttcaagttcttcgatggtcttatttaaggtataagtaataccatctgttgttgaataattttctgttccgtcagaacctttatgtgcaataaagtaaagagaacctggtgttccgagttcttccagaatcgcatttgcgtctgttacatccggaatttccacgttaatacgattgtctccttctttgtatacctgagcttcactactgtagttttctacacgtttctgaagcttataaatggtatctgacatctcatcatctgtaggattcttttttgatgcctcataagtgatactgacaccaccggaaaggtcaagaccgcgtttaatattctttgcggctcctgttcctgttggtcctaaaccgactgctgatgtaaagactaaaaatgcagtcataaacaccgtcagtatcagcacgagaattcctctgcttttcttcatgatttttcctttctttgctgattgcctcttaattctctgtcctgtcttactcttcttctgccatagccgcttttatcataatcgcacattctactctttttctttgcagttcacagccgatttcataaacatcatcaattctgcctgtaaaattataagagtttgcagcacatccgccactacaataaaatctggcaaaacagtttttacatttttcctttgcgtagacattacagtttttgaattgacaggaaatttccggtttcttaactccgtcccagacatttcccataaggaattcttcctcaccaacaaactgatggcatggatataaatctccccaaggagtgacagccagatattctgttcctgaaccgcatccggacagcctcttgtatacacaaggacctcctgtcaaatctatcataaagtggaagaagttaaatccttttccctctttattgcgtcgaatcatttcttttgcaagcttatcatactcttcacagatttttggaatatcttcttttttgattgcatactcttctttttcatctgctacaaccggttctacagaaatctgttcaaaaccaaggtcagccagatgcagtacatcttctgagaaatccagattatgatgggtaaatgttcctcttgcataatatttctgctgccctctgctgtctgcaaacttctggaatttcggaacaaccaaatcataacttccttttcccttacggaacggacgcataaaatcatgaacttcttttcttccgtcaatactaagcacaacgttgtccatttcttcattggcaaactccatgatgtcatcatctaagagcacaccgtttgttgtcaaagtaaaacgaaaatgtttattatgaatcttttcctgtgaacgtccataagcaactaattccttaacaacattccagttcataagaggttctcctccaaagaagtcaacctcaaggtttttgcggtttccggaatttgcaatcagaaaatcaagtgcctgttttccgacttcataagtcatcagggctcttcttccatgatactctccctcttccgcaaaacaatatctacatgcaagattacagtcatgcgcaatatgtaagcacagtgcttttactacggttggacggtctttaaagctctcaatcgcattttcatagatatcatttgtaaacagcatctgcgcttcttctaattcccgacattcttcaattgctgtgcgaatatcttcttctttatattgatttttaaatttttccaaaatggctgcttctgacattttttcttccagacatcctacaatatcataaacaatatcatctaccacatggacagagccactatttacatcaagtacgatgttataaccattatttttataacgatgaatcacaactttatccctttctactcttctctaaaacaggaaaaagaatcctgcaggcaggattctttttcctgtttttattgtttctaaaaaatactattatttgttttcgcagctctggtttcctactgtacaggatgttttacaagctgactgacatgaagtctggcattcgccacatccacctttttttactgtgttctgtaaactttttgtatttaatgttttgatatgtttcatcacatattcctcctgtattgatacaatttttacgcctatgcgctttcgtttattatagcataggaccttatagataggcaagtatttttatttaagacaacattcccccaagtgcccctgccataatgcatagtccataggtaataagaaactctttcagatcaccttgtatcttgcgctcggttatccatgtcactacggttaaaagcagagcgtaagaagcccccagtcccattccccacaaaaagcagtgctgtctgatgctttttccaagtgcaaagcttcccacaaaacaggacaaaatgtatgtaactaaaattccaagatgaatctggttttcgtttaactgaaatttacaaagtaaaaatgccagaattaacagcagcaaacctgttacaagatatgcgacaagtaacatttttatcatctgtgtcaatttagattgtgtttttacgctttgttccaaaaaaatccctcccatgtttatagatgtacttttcatcatataatctataatatggaaaggacttttattctatcacttattttttcatgtattttctgctttttcttcttctctttctggtcaggtctgcttttaccataatcgcaaacgatgcaaccgctgtacccatccatgcaaagagattcatactgtctcctgttttcgcattggaagaggcacttgtggaagcagttgtactttctgacactgctccactaccctgtgatgtcaaaagtattggcttttcaatcggtgttacagaagaatcactctgaccggaactacttctatttaaatttgttccaattccgctcgatgcaaccactataccggatttcaccgaagaatctgtactgtttttcttcgtaccggaattagaggctgtctttgaggatgccatcgtatttcctgctgccggaaccattgtcagacttcccgctgtcgcatcactataataagaaacacttggcttatgatttggactctttgttccaattccgaccaactgatttccgcctatattaaatgggctgaaagacgctgtctcaaacaccagatatccatctgcaagattcagattctgtccggcgacaaagtattcatactctcccttttcttccatgtaatgagcaataatcaaggattcataaagctgtgccccttccggaaccggaattctcaccgtaactttctttccttccggaacttcgtattcttcatcggtttttaaattccaaagcgtaatctcatagctttttaaaattgcctcgatatccacctcttctatatcgctatctgtaatctttgacactcgtaaatccacataaggtggaagaaaatctccgtctactttaattcctgttgcactgtcttccaggtttccaattggagctttctcttcggtctggtctggttctgctgtttcctgattctgagtgttcctgacagtctgttcaccagttattttgtttgaagtttcaccagaagcatctttctcttttccagtattttctgtctcctgaatttgctgttcccctgcattttcctgtgcgccttcttcagaaccaactgtttctttcgtctcctctgtcgtttccgattcattctcggaatcacttggggtttgttccgaagtatttttattctcttcctgtacggtatcttctgccgggttttctgttacagtctcattcttattttcctgtgaattctcatccttagcttcttcttttgaactttcctgctcgccttgtgcctcctgcgattttaaagaatctacaaacacagtaatgtaacggactacttcctcgccctgttcactccagccttccacaccggaataatcatacgtctcaatatcatttggtgtaaaaataatctgctgctggctctgataggtatccatcactttatccggctctgcaaagcgaaatgttccatctccggaaaaattttccgttaaagaaagtgtatttaacgcacctggttcactcatagtcaaagaacccggaaagacaacttccggtgctgttttctttttctgctctgtctctttctgattcgattcctctgcgtctttcgaagcatcttctttcgtatctgttttttcagaactttcttcttttgtgttctcttttttggtatcctggtctttggtttcaccctgctctgctttttgttcttccttctgacccactacaaaggcagactttccaaggtctgcctttgtagtatctacatcagattcatttagccatgcataagttaaggttacttttcccttgcctgtaactgaaagaattggtcctgtaaagccctctgcacggctcacttcaaactgcgtcggcatccgaagcgttgtctcctctgaaatggtaatcgttccacaaaccagaatttttgctccttctgtagataattcttttgctttttccagcgaattaaccgcatttgcctttgaagtaccgtcaccgctgtctgatttggtaccatctacataaatcattcttttttcctgattctgttctgatgcagcagatacttgtgtgatatgtaatccgttttgtggaacagctccgctaagtaccaatgaagaagccaatgttactcccattaaagttttatatatttttttatttctattcataataatcagattaaaatcctttcgtaaatcaaagcaatttctgtggtctttcatcttccactttatatccgacatattatagcatacttttgcttttttcaacagtccccaaatttatattttttgaaaaaagccattttccttgcaatcccatcaaaaatcatgtatcatagattaaataccatgctggttaaagtttttttccggcgaatttaaacaaaaaggagtgaagattcattggattccagcgatgccatacagtttctcattttgattatcctactggctttatctgcatttttttcatctgcagagacatctatgacaactgcaaaccgaattcgtattcaaagtcttgctgaacttggtgataacaatgccaaaatcctgcttaaaataaccgataattccggaaaacttttaagcacaatcttaatcggtaacaatatcgtcaatattggagcctcttcccttgcaacctctatggctatccgcttttttggaaatgcagccgtcggagtctgcaccggacttcttaccctgctggttttactttttggtgaaatcaccccaaagacacttgctacaattcatgctgaaaaaattgcactggtttatgcaaaaccgatttatgcgcttatgacggttttaactccggttatttttatcgtcaatcagcttgcacagggaatccttaccattcttcgggtggattccagtaaaaagggaagcaccattacagaacatgaactgcgtaccattgtaaatgtcagtcatcaagagggcgtgcttgaaaatgaagaacatgaaatgattaataatgtattcgatttcggtgattctttagcacgtgatattatgattcctcgtattgacgtcacttttattgatgaggacagttcttacgaagatttaattgagttattccgtgcacaaaaacacacacgtttcccagtctacaaagagacaaccgaccatatcgttggaattgtcaacgtcaaggatttactgctcttagacaagcaggaagaattttgtttatccagtattatgagagaaccgtattttacctttgaatacaaaaaaacttctgaactgcttatggaaatgaaagaagaatcagtttcgtttgccgttgttttggatgaatacggtgcaactgccggaattattactctggaaaatctgttagaagaaattgtaggcgatattcatgatgaatatgatgattcagaagaggatgatataacagaaatcattccagacagagaatacatagcaaaaggctctgcacgacttgatgatttaagtgattttctccatgttaacatggactcagaagattatgattcgattggcggttatattattgaacagctcgatcgacttccagaaaccggggaatctgtcacaacccctgaccagatacgtctggtggttgacaaaatcaaaaagaaccgaattgaaaccgttcatatttatcttccggagtctttgcacagccagactttctctgacaaaaatgacaaaaatgacaaaactgacaaaactgaacattaacacacagaaagaaggattgaaacaacgatgagtagtttttttaatatggacagtccggttatgaggttcttgtcccgtttatgtgatttgatgattttaaatattttatgcctgatttgctgtattccgattgttacaattggtacatccattaccgcactttattcggtaactttaaagatggtaaaaggggaagattcctatattgcaaaaggcttttttaaaggattccgccaaaacttcaaaatctctacgattatctggctgattctgcttgttatcggtgctctgcttgcctttgactttcgtgcgacaaatatgcttccggctgctttccagaacgttttccgtgttttggtcggtgcatttattacattttatattttgctgttttcctatatctttccatacattgcaagatttgaaaacggaatcaaagataccgttaaaaattcagttttaatcagtatcttaaaccttccacgtactcttttaatcgtacttttaccaatcggtctggttgtctttacattcttaaccaagacaaccttagcttatggaagcctgttatggtttttaatgggagtttcctttgttgcttatgtaaattccatttccttccggatcgtatttgcaaaatatgaaccaagtgaagacgaggaagaaccctcatttgattctgaagaagtaaacgaaacagcaaacgaagaaaaataaattttttacaggtcaggtcatagagtaaagcggatattcgcaatccgcttcgctacttgctcatgaatgttcaacttgaatctatgacctgacttctttttttatctcatttaaaatttcatgaaactgacttccacagcgctctacttctccaagcacagtctcaatcccctcttttgataaataccagttctcggctgttatcgggctttcttttgccggacacacgaaaaattcaatttccggatataagagttgataatacaataacgctcttcttgcatgatacggcatacagcagagaatcgctttttttacttccatcccttctttatccgtcactttcttagaataaattgcattttcataagtatacgttgcattatcttcttttaagatgtcttttttatccactccgttttgaactaatacctgctgtaaaaattcccattcagtttcaaactttccctgatacagttcttgtttttgcaaaacccctgcaaaatgaccaagcactacactataatgaccggatggcagaagcttcttcgcaaacccttctcggtataactctgcagcacgctcagatgggtttggaaatccatttcccggaataaaaataatatctgctttttgaggctcttggtctataaaaataaaatctgttatctgctttaaaaatttttcatacatctgtcttatcctcttctgatttcttatcacatagaaaaagaagccggtttctccgacttcttaaggcttctatttcattttcattcatctgcaaaaattacattgcgataataattccgccatcatttgcgtacatactgctgacacccgcagtatctaacaaaaccacatcttttaccggaatccgctctaaaattgcctcttttactgcctgtgcacgtgccggacagttacaatgactaattcccagcaccttttctgccggatttggtgtgcgttctaccacataatcaaccattttcatcactgctttattcattcctcttgcctggtcaagctgaacaatcgtaccttccggtgtagaacccatcactggtttgatttttaaagcagttgccacaaatgcttttaaattgctcaatcttccatttttacgaagtgtttcgagcgtttcaagcacaaaatacgtattctgttcactgatataggcatctactttttttattacttcttcaaattccatcccctgttcttcacactcttcaatttttaaagcaattaaggtctgtccaaccgacgcagagcgagaattaaacacatgaatttttttatccggatgtgtttcctttaataaattcattcccagaactgcgctgttataagaaccgctcaattcagaagaaagtgttactgcatatacgtgttctgcctcacaatcatacgctgacatataacgttctggtgacgggcaggatgatttcgggcaatttggactctctgcaactcgttttaaaaaatatgcctggtcaaaagtatcatcatctataatatcttcatcatccacggtcagtgtcaacgatgctctttccacagccggactgtctttccatttttctactaattctccacaactgtctatcacaattttatatctcatattgcaccctcttatatgtagtttctaatactatgttttataataccataaaacactatacttgaaaaggctttttccttaaaaagactttgatttttttaccgaatcgtttatacttaaaaaagtaaacacaaaaaagatgaggtttttcaatgattgcattaaacgtacaagatgtcaaagattttatggcacggctcttaatttcagaagaatttgactcattctggctctgtgaggcttcaattaccacattttcgacctttcaaattgatggaaccctgcgccctgaattttttgacactgaagaagccgaagcccttacaaaaagcggtcgcacccattgcctgtggcaggaagtaaagccctactgtttttctattatcaaaggaaaaaaaacaccgctttcctttaaaattgtatttcaattatccagacaggcttccgaacagcttctcttaaaaaatgcttcaaactggagcattaacgatatttatgggctttatttaaatctgcagtatgatggtacttccctaatctgtaccaccggcacttccatgaaactattttctatggataaatcactggatcttctctgggatgaagctgtcatcacattttttaaaaaacaccagattgccatgctttctgtctaaaacatggcatataaatgtaccacaaagtgaaggttaaaaagccttcataaatatctaacataactttacaggaggaattttacttatgatacaagatatttacccacatatttatcacaacgaatatacccctcacgaaccaactcctgaagatattgttcttcattataaagacaacactgtttttgtaaaaaaagaagaacaaaatatttcgtttttaaaattctctgaagttgtttccgtttatccaaaagcaaaagaaacatttatctatctgttttctattgataaggtttcttattatcttatccctgaacttccagaagctcttttttcaaactatcactttgaaaataatcgtcttttccgtactgcacgaccaaaagacctcgcctttgccggaatcaccggatggcagttatttacatggtacagtgaacacaaattctgtggaaaatgcggttctccaatgaaatcagatacaaaagaacgtatgcttcactgtccgaactgcaacacaatcgaatatccaaagatttgtccggcagttatcacagcagtacgaaatggaaacaaactgcttttatctaaatatgcgggtcgtgaatacgttcactacgcactgattgccggttttaccgaaattggggaaaccattgaagaaaccgtaaaacgtgaagtaatggaagaagttggattaaaggttaagaatctgcatttctataaaagccagccttggtctttttccggaacactgttatttggatttttctgtgatttggatggagaagatacgatttctcttgatgaagaagaactttccatggcagtctggatggaacgtgaaaatattccggatgacccggaacaaatcagcctgacccgtgaaatgatgaccgtctttaaaaacggagaagataaaaaatactgttaactcttaaatgaaacaaaagtgcccctgaatttttctacaaactcagggacacttttttatggttcaccttattattttgtcatttccatcataatttcattgcttcttgcaacaaattttgtcatctcttccggagtcagctgtctatgcgtaatcacagctaaatcatataactgctcgcataccagtttggttaaatctccttctttgtttgccagcacatactgcaccagtttattatttaagtttaataccagtgtttcctgtccgccaaacatagaggaatccatgccgtacatattgtacatcttcatcatttcctgcatacgacggctttcttctgtcactgtcatcatagaagaaacactttcgtttttcagcttttcggcttttactgtcagattttcttttcctaatgctttcttaaagatttcgcctaactctttggtctgctcttctaagttttcttcgccgtctgcttttacagattcattgatgtctgcatcaatacgcatgaattttacagtttcttttttctgctctacatgagaaataaatgcagaatcaatgttatgctttaagatgagcgcatcctgtccctcttctttaaacatattgatgtactggctctgctgtacttcgtctgttacataataaaccgttgttttttccggttcttttccttcttcagcatcttttttaatttcttctgctgtttcttctttattctcttcgattactgtttcagcttcctcttttgcctcttcttctgtctcattttcctttaagtaatcttccagagtcaggtattttccatccagattcttatacaggatataatccatcattctgtctgaaaatttagtgtctttcaaacagccaaatttgataaacggattgatatcatcccagtatttttcataagtttcacggtctgtcttgcacattccggaaagtttatctgccaccttcttactgatatattcagaaattttcttaacaaatccatcattctgaagagcacttcttgatacattcagtggtaaatcagggcagtcaatcacgccttttaacaacattaaaaattccggaataacttctttaatgttgtctgcaataaatacctgattgttgtataacttaatggttccttcaatggattcatattccgtattaattttcgggaaatataagataccttttaagttaaacggataatccatatttaaatgaatccagaataacggctccttataatccataaatactttacgataaaattctttatattcctcttcggtacactcatttggatgtttcatccacagaggctgtgtatcgctcaaagaaaccggtcttttgttaatcttaacctggtcttttgcaggagaaacttctacaacttctttttctccattttcattttctttttcttctgttttggcatcttcatgaatatgctctacaacaacatcatcttctcttaagtcagcttcatcaattgtttcatattcctgcggagcatttgccttggaaagataaatctctaccggcatgaatgagcaatatttttcgataacttctcttgcacggtattcatttgcaaactcaagactttcttcatttaaatgcagggtgatttcagtaccgacttctgtacgattactgtcttcaagttcatactctgtaccaccatcacaagaccagtgaactgcctgtgctccctctctgtaagaaagagtatcaatttcaactacatcggcaaccataaatgcagagtagaatcccagaccaaagtgtccgataatctggtcttcatttgttttatctttatatttttcaaggaactgggttgctcctgaaaaagcaatctgagtaatgtattcttctacttcatctgcagtcataccaagaccggtatcaatgaatttcagggttttttcttctggatttacaattacctgaatctgatttttatgattttcaggaaatgtatattctcccattacctctaatttttttaattttgtaattgcatcacatccgttggaaattaattcacggaagaaaatgtcatggtcggaatataaccactttttaataattggaaaaatattgtcactgttaattgataaactaccacgcttactagccatgatataaacatctccttttactttctctttttgcagaaaacttctcttttctgctgctaaaatcaatattaatacttaaagagtaaaaagtcaagaaaaaattagcactcattttggttgagtgctaacaaatttttataaattttctaaacaaagaataaaatctatgcaatttcacaggtgttcgattggaacatcaaaaaatagttatctcaaaaacaaatgcaggaataaattcttatactttcgataaggaagatagcgaatcggaatatctattttactttttcttacaagcagactctttttatgactaaacgtatcaaatcccgcttttccatgataacttcccattccacttgcaccgactcctccaaatcccatataggaagttgccagatgtactatggtatcattgacacatccgcccccaaaggaaagctgtgagagcacctgttttttgacagactgctcttttgtaaataaatagagtgcaagcggtttttccttttgttttaccagatttacggctctctctatggtttcaaatccaatcaccggcagaatgggaccaaaaatttcctcctgcatcaccggcgcatcaaagtcagtttcatttaaaatagtcggtgcaatctgcaaggtttcttttcgtccatatcctccgcttacaaccagttcttcttttaacagcttcatcagcctttcatagtgataacttgaaattattttaggataatctttgcactttaacggttcttttccgtacattctgtgaatccatttacacatttttaaaatcaattcttcttttacggattcctgaaccaacacataatccggcgcaacacaggtctgaccactatttaaaaattttccaaacacaattcttttagccgcaagatttaagtccgcactttcttctacaatacaaggactctttcctcccaattcaagtacaaccggtgtcagctgttttgctgcctgttccataatcagttttccaactcttggtccacctgtataaaaaataaaatcaactttctgctctaacaactttttattttccttttccccgtctttgattacagctacaaactctaaaggaaatgcttcttcgattatcttttttatcattttaaaagacactgtcgatgctccagatggttttatcacgcaacagtttcctcctgaaattgcatcaataagtggctgaagacaaagcaaaaacggataattccacggtgcaataattaagaccacaccataaggctccgcaattaccatactttttgccggaaactgagcaaggggtgtcggcacccgcttttctttcatccagctggccagatgtttttttacataacgaatctcatttaaaagaaggcctgtttctgtcatataactttcaaacgcacttttatgcaaatctttttttaaggcatctgcaatttctctttcatgttttttaattatgatttcaagcctgtttaatgcgttctgacgaaattggattgattttgtcgctcccgtctcaaaaaagtttctttgctcttttaagattttttctatttccatgcagtctgcctcactttcttttttaatcacccaaaatatttaaaaaacaggcagtctttcctaacgaaaaaactacctgccttcttttgcctcttagccctctacaatcaaatactgaccatttggaagggcaaatacttcactggcttcttcaagttcattcatggacatttcatcgacatccataccattttcttcaaaatattcttttacttcttctaaagtatccacaacaactgccatacaatcttctaaaaatgcttctgcttcttccacagtttctgcaaccggctccggaaacagttgttcctgatttcttaaaaatgtaatcaagcactcctcactaaattcattcattcgtttttcctccttaatcctatcatctttttttcaaaaaccgttttcacgtgttttgtactcttatctcagatcgagatactccctttgaaaccttaatggttatgctgtcacacatttttatgcgcttttgcataagccagaatttcttccggtttgtctacaattttatctgcatgatgttcttccaattctcttcttggacgaaatccccaggtcacaccaattgtaaacattcctgcggcatttccggtatccatatctgtattggtatctcccatataaagacactctgaaggtttggcattgaactctttcgcaatcgcaagtggtccaagtggagaaggttttcttggaatttcggcagtctgaccctgcactttatcaaacaattcttctccaaatattttatttaccacatctactgctgcatgatgtggtttatttgagcagacacctatcttaatgccttctttttttaatccatttaacatctccacaatgccgtcaaacggctttacatgataaaacggatcctcttcaaaccatttgcggtaaatctgttttgcttcttcataatcaactttatctattccgccggatgcctctaaaattcttcttaccagctcatctgccccatctccggcaaaaaaattatatccttctaccggctgttctttaagtccataatggctcagcagacggtttcccactaccgcaatcgattctaccgtatctgcaattgttccgtctaaatcaaaaatacatgcttttatcatttgttctcccagtccttccagctcattcccatattttttacttcctgatataatcttgaaatcggcatacctaccacattataataatcgcctcttatctcttttataaattttgcacagagtccctgaattgcataagctcccgccttatccatcggttctttgctctgtacataagttttaatttcttcttcactcattggataaaatacaacttctgtcttttcaaaaaaagtctgttttgtctctgcctgattttctctcacaaacagactcactcctgtataaacaaagtgagaatttccctgaagcttttttaacatagacaccgcgtcttcttcatctgccggttttccaagaatgtttccatccacagcaactacggtgtccgctccaataacgcagacatctcctgttgtttttgaaaatacgtcctctcctttttggctcgaaagctccatcacgacttcttctggattcgtgcttgtaatgacctcttctgcttcacttttacagacttcaaatacacatcccatctgagtaagcagttcttttcgtctcggtgagccactggctaataagattcttttcatatcttaagttctccgttgttattcttttgaatgtaaatcattgcttctacattcttaactcttttttagtataatatttcttcgtcctacatgcaatatcttttatttgtaaaaaattcatttcacattcttgttaaaatgtattataatggtaataataaaaacagacagttagaaaggacgtatgtatatgggtagtttttataagaaagctttaggatttggagcacttggagctgcagctggagccgttgcatattatctcaaaaaacaaaaagaaaaagaccctcagcttgaagaggattttgcagattttcatgataatatcaaagaaaccgcttcctctgccgcaaacgttgcttcccgcttaaaagaaaaagtggaacaaaccgtagaagaaaccgttcagaaagtaagagaacatacggatgatatcctcgatgatttagataaactcgatgatgaaactatctttgaggatgacgaattttttgattctccgtctgacacctcagaagagtttgaatcttccaaagaagaagaggacttcaaaccagtcgaagaaagcaaagaagaaccaaaagaaacagaaacagataacgaagcagataaagaaaacgaaatcgaaaaagaagaaagcagtgaagccgcagcggatgaaaaagattctgataccgatgcttccaaagaaatcgaactttaatatgaattcactcaaagaagagtattgtctcaaattcaatactcttcttttttgtccaaaaatcgtcaaatttcgttgatttattttgctaatccgataaaactatgctatgataggactattggcaaaaacgtccgattttcccgtttttgttcatcagacagcctagtcctgtatcaatgatatttcattaaataacttgtgtaaatttccatctgctacgttgtcgtcaatcgccgtagccactacggctcattcctctgtcttgcagattgaaaatttatcctgcgttatttgtttaaaagtcaatgatacagtacactaaattttactcaaaggaggattttttcatggaaaaaatatggattgccggtgcaaaaggacacgttggctctgccttgtgcgatttacttgactgcagacattatgaaattctgccaacggatttagaggaagttgatatcacggaccgtgaatcagtcagcaattatgttcgtgtcagccgtcccgatgttttgattaactgtgttggttttggtgatattgcttcttgtgaagcccagccggataaggcatatcaggttaataccgtgggtgcacgaaatcttgccgtacaggcgcaggctatcggtgcaaagctgattcatctgtctaccgatgacgttttctctcatcatgccagacagccttataatgaatttgaaattccaaccccttccaccatttatggaaaaagtaaacttgcaggagagcgttttgtacaaaatctctgtacccgccatgttatcgtaagaagcagctgggtctacggtattggaagagattttgtaaatacgattctagaagccgcaaataatccttctgtcacttctatggaagttgcagaaaacgaatttgcaagccctacaagtgcaaccgaacttgcaaaagtgattgaacaactgattgataatgactgtcttggtatttatcatgcagtctgcggcggattttgcagccgatttgaatttgcacaagcgattttaaaggctattcacgcaaaggataagctgactttaaaaccgatttctgattcagaaactatcaattattctgttcttgataatatgatgcttcggcttgaaaattttactcagccgatatcctggcagcaggcattaaaagactacataagaactacaggaggaaataactaatgccaaaaaccaaaaacaccaaaaagaaactcagcctgtccactctgatttttacagctctgcttttgggtgctcttttcggagtcggacttcattatctcattcctaccggacatatccgtgatgatatcataatcgaaggcatgctttatgttgtcggtcagggatttatccgtctgatgcagatgctcgttgttccacttgttttttgttctctagtatgtggaagtatggcgattggagatacaaaaacacttggaaaagtggggatcaaaaccgtactgttttacttatttaccaccgcaatggccgttaccgttgcactgagtgttgcttctctcattaatccgggacttggcgtcaaagtagacaacatctctacttctgaagtttccctttccgaaagtaaaccactgacagagattcttttaaatattattccaaaaaatccaattgaatccttagcaactgccgatatgcttccaattatcgtctttgctttatttgtcggtatcatgttagcaaaacttggttctaaaacatctaccatagccaattttttcagccagttcaatgacattatgatggaaatgactatggttgttatgagtgttgctcctatcggtgttttctgcctgattgcacgtacgtttgcaaatatcggattcagtgcctttgttccaatgttaaaatacatgggcgctgttattcttgcacttgctattcagtgttttggtgtttatcagattttattgttcttatttacacgacttaatccgatgcgctttattaaaaagtttttccctgttatgagctttgcatttaccactgctacttcaaatgcaacaattcctctttccattgacactctgcacaagaaaatcggtgtcagcaagaaaatctcttctttcacgattccactgggtgctaccgtaaacatggatggaacttctatcatgcaaggagttgctgttatttttattgcacaggtgtatggaatttctttaactccttctgatttactgaccgttgttgcaacagctacacttgcttcaattggaactgcaggtgttccgtctgtcggacttgtcactctggctatggtcttacaaagcgttggacttccaaccgagggaattgccttgattatgggtatcgaccgtattcttgatatgctccgtactgctgttaatattacaggtgatgcggtctgcactacaattgttgcacatcaggaaaaagctcttgaccgtactgtctttaacgaaaattaaatattccagttcaaacaaaaatacaggctccgcatcagcggtcagcctgtatttttctaatatctgaaaatcctgtattttgctgaacgatttccacatcaagaccttcatctgcaaaatagcctttttcctgttaatcgacgcctgaatctttatgctccctccgccggtgttatccggttcaggtctaagggtctaaaatgacttccctgttctattctcaaccggattccaccaattcccctgttattccttttcaagcctaatctactctatacctacagtcaatactcttttttccatatcctgctaagaatctgcaaagcttctttgatttcttcttctgtaagcgttgcatatccaattaacacaactgcttctgtttcttttttttcctgtacaaaaaattcagataaaccatagacacgaatgcctgctgattttgcgcgctccactgcctcatcttccgaaatcccattatgaaagcgcagcaacagatgtattcctgcatgttctccaaaacaactgcagatttcgctcatctcttctttcacccagcgaagaatccagtcatgtttacttttataaagacgtctcatccgatttaaatgccgttcgtaatgtccgtttcttaaaaacagctctactattttctgatctacttttgaaatggttactgcaaacggatatctgctctgatagtatcgcatcaatttttttggaagtgccatataactgattcgtatcgatggtgcaatggattttgaaaatgttccaatataaatgactctttcgtttttatcaaatccctgcaatgccggtattggtttgcctttatatcgaaattcactgtcataatcatcttcgataatataagtctgattctcatctgcccagcgaagcagttccatccgacgtttcaggggcattactgtccccattgggaattgatgtgaaggcatcacataaaccacgtcagcacctgtcttttcaagttcttcgatacagattccatctcatcgctctttactgtacacactgaacagcctgtatgtttcaaatcataccaggcacttaaatacgttggattttccattgctacttttttattacattcaaaaagggtagccaaaaccataagcagataatcatttcctgctccaactaaaatctgactcttttcacactttactcctctggcatgatacaggtactctgcaatagcttctctgaaagaatcttctccatagggatttccctgtgcaaaaatttcttctgtagaatcacttaacacctgttttgccagctgtttccaggtatgagttggaaaactttccggtgcaattccatttagtgcaaaatcgtaacgatatttctgtaattttcttctctgttttatctctgtcttttctggattgttttgtttcgtatactctgctttttgaaaataaatcccttctatttcgcaaacataatatcccttataagcaaccggttcaatataaccttccgcaactaactgatcataagcagtttcaatggtacttcggctgactagaagatttgctgaaagcgcacgggaggacggcaaccgcatccctgcgacaagccgtccttcctgaatttcctgtttcaaatattcttcgatttgctgatacaaaggagtgaggctttttgtatcaagcggaatcattaattcattcatagcagtttttcttatttcttttctaatttgaaagaactcttaagtgaaacaatacggttaaatactaacgcatccggtctgctgtcatggcagtctgtacagaagaaaccatttcttacaaactgatagctgtcaaatgcctgagactttttaagttccggctctacataagcctttacaacggtcagggaatttggatttacattcaaacttccgtcttctttattataaacgcctttttcttcgtctacaatattttcatacagacgacattctgtttccactgcggtctttgccgcaacccagtgaatggttccttttacttttcttccgtccggagagtttccacccttagaagcagggtcataagtacaatgaacgactgtcacattcccattttcatctttttcaacatctgtgcaggttacaaaataagcattcatcagacgtacttcatttcccggatacagacgtttgtattttttaaccggtacttccatgaaatcttcctgctcgatgtataattcttttccaaatggtacgcttctgcttccaagttctggattttccatgttatttggagcttctaagtattcaatctgctcttccgggtaattgtcaattacaagttttaatggatttaaaacagccatcacacgtggacgtttcattttcaaatcctcacggatacagtattctaacattgcataatctacagaactgtttgcttttgaaacgccacagagttctacaaattttttaatagattccggtgtaaatccacgtcttctaagtgctgcaatagaaaccagacgcgggtcatcccatccatctacaattccatcttctactaattttttaatgtaacgttttccggttacaacatttgttaaatataattttgcaaattcaatctgttttggcggatgtggatattctaattctgtaactacccagtcataaagcggtctatggtcttcaaactccagtgtacagatagaatgtgtcaccccttcaatggcatcttcaatcggatgtgcaaaatcatacattggataaatgcaccatttatctcctgttctgtgatgattcatgtgtgcaacacgatagatgaccgggtctctcatgttaatattcggagatgccatatcaattttcgcacgcagtactttagaaccgtcttcaaattctccatttttcatgcgttcaaataaatctaagttttcttccacactacgatttctgtatggactttcttttcccggttctgttaaggttcctctgtattcacggatttcttcagcagataaatcacagacaaaggcctttccttttttaattaatttaattgcggcttcatacatctggtcaaaataatcagaagcaaagtataaacggtcttcccagtctgctcctaaccattcaatatcttttttaatagactcaacaaattctactttttcttttgtcggattggtatcgtcaaaacgcatgttaaattttccatggtatttctgagccagtccatagtttagaagaattgactttgcatgtccgatgtgaaggtatccgtttggttccggtgggaaacgggtacaaatttcatcgtatacaccttctgctaaatctttttctataatctgttcaataaagttttttccaactgtttcttctttgttttcttctctgctttcgatttctttttccactctttattcctccagtctctttggtctatgaattatactaccataaaaacggtatttttcaaaggttttctgtatattttttatttttccggtatcagcataaagtttaccatcgcagttgccaaaagctttccgcttttttctgaataacactctgtatgaatatttgccagatgctttccaaccctgtctgctttcgccctcactaaaagtgcatctgctttttctcctgggcgcagataattaatgttcatattcgtagtcggcgtgatatgacatttgcttaaactgcgtaccaatgcaccacttgtcgtatcaattgctgctgcaatcagacctccatgcatcgtaaacatgtggtttaattcccaatcctgtatcggccagcgaaaagtcagttcttttttttcaaaatcacacgaataaaactccagtgccatttttcggtacaaatgatccggatcacttggatacatttttttgatgctttctcttacttcctcttccatttctatttgttcctgcaagatatttgacattgttttcctcttttctgttctttctttttccgatttattttcaataacgaacttctgatagagtaagacctcttgccggtacggtaaatcctgcactactgcgctccttagcttctaaaatcccatcaattgattctgccattttctcgcctctcccaacttcaatcaatgtaccggttaaaattcttaccatattgtaaagaaatccatttccccgataagtaatccggatttctccattttcctcttctaatttaatttcataaattgtacggacagttgattttttcatttttttattcgaacaaaagctcttaaaatcatgcgttccgacaagtttttctgctgcttttttcattgcttttatatccagcgtttcctgcaatggataaacgtatttccgctcaaatacatttttgtgcccacctgttaaaattcggtactgataaatcttttcttttgctaaaagtcggctgtgaaaccgtggttctgcctcactgacacactgaactgcaatatcttccggcaaataatgatttaagtactcacagatttcctcgcagcttttttctgtttccagatggacatttgctacctgcccctttgcatgaactcctgcgtcggtacgaccagcaccatcaatttcgattggggtttcacacattttcgagagcacttcttctattttcccctgtatggtgttagttgtccgattctgcctctgccagccctcataacgacttccgtcatattctatatccagcctgtaattcatactttttgattctgccctttctctgtttttcttcatatcattatatcaagttctgatatgcgggtcaaatctgcaaatcaagactggttttctcattcttattatgttattcttcttccaaacggatctgtgcaatctgctatattcacttgcttgattcggtaaatatgtacccttgagtacacaactatttttgggagaagaggcgctgcttctattgtattcgcaatcatggcgacggttgatgatgcctataccagtatagatctgtttcatatattttggataaagatttgcttgtgatttattcttctgacaaatacaaacctgatttttcttcttaaaccctgtctgatttcttttcttattttttgggatactgtacttctcttctaagtaaaaacaacgccagcagattgggaattgccataagaccatttaaggtatccgacaattcccaaatcatggcaggtgcaagcatacacccaagaaatgccactgctacatagagccatttataaatttttgttcctttttcttttgcaagataaaccgcagtccgctctccaagacacgaccatccaatcatcgttgcaagggcaaaaagtagcgtagataatacaagcagttcctctccaaacggaatcacacttccaaatgccctcgccattaaagtcgttccatctatattttcaattccagttgaaaagttttgaatgcagatttccggacgatacacaccactgactaaaagcacaagtgctgtcaccgtacagaccagaatcgtatcgacaaatatttctgcaattccccacattccctgaatttccggcttctctacatcagactgcgcatgggcaatcaccgaagaacccagccctgcctcattggaaaatacccctcttgaaattcctgtttgaatgattgtttttaactgatatccgccaacccctgcacacgctgctcttggagtaaatgcattttttataatttcccaaaatgcccatccaactctgtgccgacaggcaatcaaaatgccacacgctgttatcagataaattcctgccataaaaggaactaatttttctgtacagactgcaatccgcttcattcctccatttaaaatataagcaaccgctactgctgatgcaaccgctgtaaaaaacacaggaatctgaaatacgtttttcaagccatttgccatggaatttccctgcaccatatttcccattccaaaagatgctccaatgcagcaaaaagaaaagactactgcaagccatttacagccaagtcccttttctatatagaccatcgcacctccgacccactgacccttttcatctttataacgataggtgattcccagatagttttccgcataattggtcatcattcccaaaactgcagaaatccacatccaaaagatagagcctggacctcctgccattatcgcggttgcaacccctgtgatatttcctgtaccaagcgttgctgccagtgccgtacaaaaagactgaaactgcgaaaccgcctgtgtttcttttgtatttcttatttgtggatttttaaaaagtgaacccagagtctgtccaaaccattgttttatccttaaaatcgaataaaattttgactggacagtaaaataaatgcctgtcaataaaaaaaatgccaacattcccggactccagacaaactcatgaagggtatgtaagatttgttccatctcttactgctctcttatttcgctctatttaaagcagtatatgaaaaaactgccttggttatcccaaggcagtccattttgttactggatttattcaatttcaagcaaagcttttttaattattcaaaagcttttccaacagaaccaaacagttccattttttctttgattgtatcacagattgcttcaaagcctggttttaagagtttacgagggtcatatccttttccttcgttgtcttttcctgcttcgatgtattcacgtgtagctgctgcgaatgataactggcattctgtatttacattgattttagatacacctaaatcaattgcttttttaatcatgtcagccggaattcctgtaccaccgtgaagtactaatggcatttcacctgtgagtttctgaatgtcatccaggacatcaaaacgaaggccttcccagtttgccggatattttccgtgaatgttaccgatacctgctgctaacatatctacacccaggtctgcaatcattttacattctttcgggtctgcacattcaccctgtccgattacaccgtcttcttctccaccgatagaaccaacttctgcttcaagggataatcctaatcctttgcaaacacctgctaattctcttgttttttcaacattttcttcgattggataatgagaaccatcgaacataatagatgagaaaccagctttgatacatttgtagcatccttcataagtaccatgatccagatgcagagctacaggaactgttatattgagttcttccatcattgcttttaccatagctgcaacagtcttaaatcctgtcatgtatttacctgcaccttcggaaacacctaagatgattggggatttgcattcttctgctgttaacagagctgcttttgtccactccaggttattgatgttgaactgtcctactgcataatgtcctgcttttgctttttttaacatttctgctgctgatactaacatatttctgacctccatttggtaaattaccgtcgtttttgttctaagaaaaatgcaaaacaacgtttgttattattataacacatttcccttttctggcaagtatttttaaataaagttaaaagatttcctattttctggacacaaattttgcaagcccatctgttcctaccggcacttctacctgtccctgaaccagcggaagtgcatagaaaataaactcttctccaatatcagagccctcatttgtaatccaggaaagaggaactgttttttctttattacaaatttcattgacatcttctaatccaagtttcatggcataaggcaggttactgattctgatataagaaaccatttttccggtttcaccttttaatgccaaacgcacaccaaactctccggcagataccgcttccttctggtccgtttttgacatcatagaagaagaacatctctgtgaaacatttaattcaacggaacgtgcttttacaccaagacggtttctgactaaattttccagatatttgccacatcctgcaagcatcttatgtccaaaggtatctgttccaactgcattatcatactcacagataaagacgccatctttatcatgaattccttctgaaacacaaacaactacattgagatttttttcaaaacaagcttctactttttttaagaaagcttcttcgtcaaacgcagtttccggaagataaatcaaaagcggattatctccgacactctttcttgcaagcacagatgctgcagtcagccatcctgcatgtcgtcccataatttcgataatggtaacggatttcttttcatagacatttgcatccaacacaatttcacgaacggtagttgccacatattttgcagcacttccaaatcccggagtatggtctgtcagcactaaatcattatcaattgtttttggctcaccaatcacacggatatcacttcccactttttttgcatatcgagaaagtttacttactgtatccatagaatcatttccaccgatgtagaagaaataaccaatttctaactcttcaaatttttgaaataatttcggatataccgcatcttccaaatcttccggaagcttatatctgcaagaacccagatatgctccgggtgttgtctttagatattctaactcttctcccggaagtgcttcttcaaaatccagtacagttccatttaaaaatccttcaattccatttaccattccatatacgtgtgcaattttttctttctggcgaagtccttcttttaccactccataaagactgctgttaattgccgcagttggtcctcctgactgtcctacaatcagattttttcttgtctggctcataaaaatactcctttctgataccttctttatcagaatatcatacaagcaattttcacacaagcgttacagcaggtttttttccaagaatggaaagcaggtttgcacaagtaaattcccgcatactttcttttgatttttctgagacatgttcaaactgggccagatacacaaagtaaccaaataatgctggaaatgcaactgcctgaatctgaaaatctgaaaactctggatgaatactgttttcttctcgcccctgttttgcaattaattcaagcaccgtctgtgcgtattctctcgcagatttcattttttcctcaatttctttttgtgccttttcttctgactggggcagtttaaataactgccggcaaccattgtctttatataccacgttttcaataaaattaaatacctccatcagctggtcttttaaacttttttgtctctttaagttttctaccagttctaaaaatctctgatttccatgccagtatattgcctttgcaatcatttcttctttactcgaaaaatattcataagcagttccttttccaacacctgcacggtttgtaatatctgaaacttttatctgatgaacttccattccctcatctaacagttctattaccgcctgatatagaagaagttctttttcactcaaagttcgcttctccatctgctaatctctcctcatctttcttataattgcgacggtttaagatatcatacacacaaggcacaacaaacagtgtaagcagtgttccataaatcaatccgccaatcgtaacaattgccatcggctgcatcatatcagagcccataccaacacccattgccattgtaacaagaccaagaatcgttgtaagagctgtcatgataatcggacgcagtctggaacgccctgcctctgcaattgcttttcgtttttccattccttcttttcgaagctgattaatataatcaaccaatacgataccgttattaacaataataccagaaagcatgacaaatccaatcattgcaaccacactaatcggcttattggtcaaaatcaatccgataaatccaccggtaaatgcaagcggaatcgtaaacatgataataaacggagataagacagactgaaactgcgccaccatgattaaatacataaataccagcgcaagtgcaagcattaacattaactgactcatcgcattattaattgtctcatcttcacctgtcatttccacagtatatccatctggaagctcgtatttgtctaatactcgctggacatcctgactgacaagcccaatgttataaccggtcgcaatttccgcactcacagacatataacggctttgggcatctcgtgtaattgtctgtgggctctgggcatcttcaaacgttgcaatatctccaacttttatttcttttgtttctcctgacgcatctgttgtctcaattgtaatctccgaaagtgcttctcttgtcaaatcctcatctgcttcacttgtcacatacacatcataatctttcgtcgctgttgaaattgtggtagcagaacttgcttctgcaaggcgtgcattaatcttctggaatacctgtgcaacggtcagattattgcgcattgcttttgctttatctacgataattttatactgcggatcagaatcctgaagcccatcagaaacattctgtgttccctttactttttctacctgtcttgcaaggtctgctgagatttcctgtaaagtatccaactcttttcctttaattcggatattaattccactgcttccaagcgcactcatatccatagaggaagtggaaatgttaatctcgcagtcttcgattcccttcgtgcgcttcttaatctctttttcaagtccggcactggatagttttctatcttcttttaataccagatacatcgtcacctgattggtcgaggaacttccagataatgatattgaagaaccacctgccatagctccaatggtttcaatatcttcgatatcttcaatcttctgaatcacttcatctgatttttcagcagtttcttcaagcggagttccactatctgttgttacggtcagtgttgcctgtgtactttccatgtcagggaaaaattcagttcctttctgaatcgataagtacatgcttccaaaaaataatacaagtgcagcaattaacacccaaactttatgttttaatgcttttaaaaccagtttttcatataaatcctgaatctttccaatggatttgacctgttttgcctctccctttctcaaaattccggctgacatcattggaactaacgtcaatgctacaatcaaacttgcaagcagggaatacgcaattgtcagtcccatatctacaaataactgtcttgtaattccttcggtaaatacaattggtgcaaaaacacataccgttgtcaaagtagacgctgcaatcgctcctgctacttgagaagccccttcgatggctgcttttcttgcgggtactccaagtgctctcattcggtaaatattttcaatcactacaatcgagttatccacaagcataccaactccaagcgcaagccccgacaaggaaataatatttaatgtcactcccgaaaaatacatcataacaattgcagctacaacactaatcggaatggaacatgcaattacaaaagtcggcttgatatcacgaagaaataaaaacagaattaagattgccaaaattccgccgtaaatcatgttttccattacggaatttacaactaaatcaatataaattccctgattcatcaatgtcgtaaaatgcagaccatcattggaagcttctaattcttccattcgatttaaaattttatctgtgacatctccagtggaatatcccgtctgtttttcaatcgaaagcatgacacctggattgccattgatttttgcatacacttcagaagaatcatcttccacattaatatctgccacatcagaaagtgtaatggatttcagaccatcaatccccaaatccatgataaccaaatctccaagagaatctacgtcctgaagtttgtcgcctacacgtatcagataatcacttccatcttctgtcacataacctgccggcatcgaaaaattctctgctgttaagattccttttatcatatcagaggttaaaatctgattcaaatcggatttttcctgcgcctgttctttcgcttcagaaagttgttcttttccagaatcaagctgagcctgcgctgtttcaagttgaacagaacccatctcaattttatttgcagcagtacttaactgtaccgaacctaaaattttctgtgcctcaagttcaatctgcgcagaagtcatctgagattttcccgcttcaatctgttccttcgcacttgttagcatttcttttccggcatctaactgttcctgaccagaagccaactgtacctttgcttcggcaatttcttttaatccctgatttgccgcctcaattccagtatcaatactttccgattgaaggttttccatctgtgcatttaactgttctaactgagcagtcagctgctctttttgtgcctgtgcggtttctaagccattctgcacggtttcaatagacttcttccactgttcttcggtcatgccatccggctttttttctagtgcatctaactgcccctgcagattttctatctgcgcatcaatctttgaaatcgcatcttctaactgtgactgaccactttctgcttctgaaagctgtccctttgcctctgtcaactgctcaatcgtctgatttaataacgcttctgtcttttctaataactgtttctgtgtatcaagctctgcctgcttactttccagattttgaagctggacatccacttcagcagcattttttgtcaattcactttgcgcttcatttaattttgcgcttccctctccaatttgagaagctgcctcgttttgccctgcttctaattcctgctttccatcctcaagctttgctttattactgttcaattcttcctgtgcatccgctaaatcctgttctttttcttcaaactgtccattgattgcatcctgaactttttgatttacagcatctaacttttcctgactgatctgaacctgaatactctctgtgacatttccactgacactgattctggcaactccgtcaatactttctaactctgactgaacattgttttcgatataatctgttacctctgcggcagacattccgtccacatcagctgctgcaactaataccggcatcatatccggatttaatttcatgataatcggatttcctacggaatcgtcccaatatccttttatctggtctaaattttcccgcatctccaatgtcacggaatccatattggtggactccccaaattccagaattacaaccgatgcattttcacttgacattgaacttacatttttaatattgcttaccgttgccatactctgttcaatcggtttggtaacggtctgttctacggtttcaggacttgcccctgggtaggtagtcataacaattgcataaggcagatccatacttggcagtaagtccgtactcatctttgtaaatgagacaacaccaagaatgataaccagcacaactgcaactatcacagtatacggctttttcacactgaattttgatatcatagcctcctccatttcgctttcttttaagttgaatttttccgactgactggtcagtcagttgtgaaatcattataaaactgaataaattctttgtcaataaaagaacttgcttcgtaaaataaaaggcagcaggaaattcgactgttctctcatttcctgctgctctcattatcctattttcagtaaagctgtggaatgcttatctgaattcagattttcttacttctgtgcttctattttctccgctaaatcatttaaatacacccagcgatccattttttcttctaactcctgttctgcttcctctttttctttcattaattctgaaagcttcatggaatttgttgcattttttaccatctcagcatccaaaaattctatttttccctctaattctgcaatgtcatcatctattgtctcaatttctctttgctctttataagaaaattttaatttctgtggacgattctgtttccagtttttttgtgccgtttctttcttttctttcttctctgattttagaagcccatctacactacttcccattctctccagttttgcttcaacataatccgtatatccaccttcatactgctgcaagtgaccacaaccatccaattcaaaaattcgatccactacattatccaaaaaataacggtcatgggacaccgtaattacaatcccagaaaaagagttcagataatcctctaaaattgtcaacgtcggaatatccatatcattagaaatctcatccaaaaccaggcagtttggagcagaaatcaatacacttaacaagtacagccttttttgctctccgccggaaagtttggatactggtgcatactgcatatcaggagtaaataaaaaccgctctaacatctgtgacgctgtaatccttccatcacgggtcggaacatactctgcaatatctttgatataatcaatcactctctgattggtattcatatccggtacttcctgcgcaaagtatccgattttcacagtctctccaacctcaatctgaccagaatccggctctacaagccctgcaatcatttttaaaatggttgattttccgcagccatttggtccgacaaatgcaagtctttgatttcgaagcacaatataatcaaaatcctccaccagatttttttctccatacctcttactgatatgatgaagctccaccgtcttctttcccattctcgtctctacagaatcaagttctaatgcctgttcctgaaccggtgcttttccattttttaatgcttccagacgctctaatcttgctctctgctttgtacttctggcacgacaaccacgttttgcccattccagttccattcgaagcacgctctggcgtttccgctcggatgcaagttccatctcttctctttgcgcttttaattcgagaaatccagaataattggattcataactatataaattcccacgagaaatttcaagaatcttattcgtcactttatctaagaaataacggtcatgcgttaccataattactacacctttatagctctttagataatcctccagccatacaagcataccactatctaaatggttcgtcggctcgtccaataataaaatatcaaacgaccctgtcaatacttttgcaagcgcaacttttttcttttgtccaccggaaagctcactcaccctctgttcatggtttgtaattccaagctgatttaaagcactttttacctcactttgcgccgtccagtctgtctcatctattccatccatcgcataagacaaaaccgttgcatgttccaaaaaacatggattctgtgacagatacgcaagacgaattccattttgcataataatctgcccttcatccacctcttccactccggcaattatattgagcatcgttgttttccccgttccatttaaaccaacgattccaatcttatccccttcctgtactccataagagacatcatcaaaaatctttttatctccaaatattttgctgacatgttcaatatttaatatgttcatttttgctttcttccctttgccttctttctttaaatgacatagtttcctacatcttcactatttccaattaaatcctgcaaagaaattttatcaaaatagtcctgaaccaacttatgaaagtctttccacatttttaatgttttgcacgtatctacacgctcacaggtatttacttctccttctaagcaggcaaccggtgcaagggaaccttctgtcacttttaaaatacttccaatcgaataatctgccggcgcttttatcagtttatagccaccgccctttcctctctgggcgcgcacaaatccatttttactaagagctgccacaatcgcctccagatatttttccgaaatttcctgtctctttgcaatatccataagtggaatatattctcctgtgttatgttctgccaaatccagcattacccgaattgcataacgtcctcttgttgatattttcatctataactacctccatcttttaacaatgcagtatccaaaaatttctaaactgcatccttccatccatatttcctattttaccatggtcttactatgtattcaaggcaagaaagcgacacaagctacgagatttggaaacaaaaaccgaagagttctcttaaaagaaaactctccggtgctctttttaaatataatacatttcctgcctgtcatagtgctcagaataatacaagaccagttgtgagattgtcagattttccagtatctcatccagttcatgattcactttgtcaatcacaagacgctgaatcgtatctgcaattcccacgtactcactgtttggctgggctacctggttatctaagtgatatgttccttccaaaacctgtaagacatctgccactgtaacttcagctgcactttttgccaactgataacctccctgtggaccttttacgctccgcacaagtctggcacttcgaaaggcagcaaaaatctgttctaaaaactgttgtgaaattccatttctcttcgcaatatttcccagagaaactggtccattttgggaattcactgccaaatcaatcaacgaaattaaaccatatctggtctttttagaaaagctcattcttagtcctgtacggctttgaatgcttcatccaaatcctggataatatcgtcgatgttttctgtaccaatggataaacgaattgtatttggcttaattccctggtctaacagttcttcttctgtgcactggctgtgtgttgttgttgctggatggataaccagagattttacgtcagcaacgtttgccagtaaggagaataattccagattatcaataaagtcttttgccttttgagcatctcctttaatttcaaatgtaaagatagaaccaccgccattcgggaagtattttgcgtacagttctttctgtgttgcatcatcagataccgatggatgatgtactttttctacctgtggatgattatttaagtattctactatttttaatgcattttctacgtgacgttctactctaagagataatgtttcaagtccctgaaggaaaataaatgagtggaacggagaaattgttgcccctgtatcacgaagtaagattgcacggatttttgtaacgaaagctgccggtcctactgcttttgtaaagctgattccatgataacttgggtttggctctgttaaagatgggaattttcctgaaccttcccagtcaaatttaccactgtctacgatgacaccaccgattgttgtaccatgtccaccgataaatttcgtagcagaatgtacaacgatatctgcaccgtattcgattggtcttacaagatatggagttgcaaatgtattatctacaacaagcggaattttatgtttgtgtgcaatatttgccagagcttcaatgtcaacaacatccgagttcgggtttccaagtgtttcaatataaattgcttttgtgttttcctgaattgcagcttctacttcatcatagttaaaaatatctacaaatgttgttgttacaccgtactgtggcagagtatgcagtaacaggttgaaagaaccaccataaatattttttgctgatacaatatggtcaccattctgtgcaaggttttcaattgtatatgtgatagcagctgctccggatgcgactgctaatgctgccacaccaccttccagtgctgccattctctgttcaaatacatcttctgtcgggtttgttaaacgtccatagatgttacctgcatcggcaagaccaaatcttgctgctgcatggtcgcagttgcggaatacataagatgatgtctgataaatcggaactgctcttgcatctgtcaccgggtctggtttttcctgacctacgtgaagctgtaatgtttcaaatttgaattttctattttctcttgtaattttttcactcatagtttaatatcctcttcttctcttttttatttaaattattctgtgaacagtggtgtagagtaatatctgtctgctgtatccggtaacaatgctacgattgtttttcctttattctccggacgctgtgccagttcaattgctgcgtgcagtgctgcacccgaagaaattcctactaaaactccttctttcttagcaagcagttttcctgtcttaaatgcatcgtcattttcaattttgataatttcatcatagatatcagtatttaatacttttggtacaaatcctgcaccgattccctgaatcttatgaggaccaccttttccttctgaaaggactggagagcttgccggttcaactgctacgattttcacatccggattctgagattttaagtattcacctgttcctgtcagtgttccacctgtaccgacacctgctacaaagaagtccacttttccgtctgtatctttccagatttcaggaccggttgtttctctgtgtgttttcggatttgccgggtttacaaactgtccaggaatgaagctgttcggaatttcttttgcaagctcatctgcttttgcgattgcacctttcataccctgagcgccttctgtcagtaccagttctgcaccataagcttttaagatgtttcttctttcaacactcatggtttccggcatggttaagataatacggtaacctttcgctgctgcgattgctgcaagaccgattccggtatttcctgatgtcggctcaatgataacagaaccttcttttaatattcctttttcttcagcatcttcaatcattgcttttgcaattctgtcttttacacttcctgccggattaaaatattccattttaccaagaatggttgcttccagacctaatgcattttcaatgtttacaaattctacaagtggcgtatttccaattaatcctaatgttcctttataaatgtttgacataactctttccgcctttccataacaattctttttatttttttatcgctaagcttaactccctttaacatactcttttaatatgttttctatgttttacatcatatacctctttttttgatttgtcaacacttatctttcatttttttagtcaagcggatattcgcaatccactttcgctacttgctcataaccaaatagctgctacgcagcttatcagaaggggcttgccccctcctgatacaagcaagtccccacccctgcttattgctttttgcaattgaagcaggggacttccttgatttggttaaaaacatagtaaacttatcagcaaactaaaagagtccttaaaaatcagctttttttgctgatttttaaagactctcaacttagattaacttattaagactgcgcttttaaaaatgcttcgatttcactttgttttgctttcacagacccctgaaccattggaggtcttcctccaccccttccatttaaggtctgattcatttcttttgaaatattcgtaatctctttctttgaagaaccaagaatataacgatacccctccgcatctgtcccaataaatgctccgcagattccatctgttattctcattacatcattgacgaaatttcttactgccacggtatctaatgtttcttcgaataagagcacgcaggtatcctccggctttatctcttttaatactccttttaagtactgttcctgcaaaatccgaattttttctttctgtgcctccacttctttttgcagacgctctactgcttccgcaacggaatccggttttgcagaaagttttcttgaaattgttacgacacttgcttctttttgattataatccaaaagcgcacggaaaccgcagaccatcgaaactctcattccacccttgtatttaattgcaccgattaatttaattaagccaatctgaccggtagcatctacgtgcggtgcacagcaggcacagctgtcccagcccggaatcactacgatacgaacctgtccttcgatttctattttgcttctgtaagtcatcgtttcaagttcttcttttgtcggatacaacacttgaatttttacattatcggcaactgcttgatttgcttcccattctatctcttttaaatcagtttctgtaagcatgccgtcaaaatccatcgttacctcttcatttccaagatgaaatcctacattgttgtagccaaaacgacggttcacgattccagatacaatatgctctccggtatgctgctgcattttggaaaatcgttctttataatttaatcttcctgtaactttgcttccctgctcaattgcgtctgttacataatgggttacaatctcatttttttcctgtacatcaacgacttttacttctttttctcccacaagaaggactccggtatctgcatactgaccgcctccttccggaaaaaatgctgtttgatccagtatgacttcaaacataccgtcttttccctgcatacaactttcaactgttgctgtaaattctttgatactgctatcctgataaaataatttttctgtcattttactaaaatcctttagtccccgtatacacgaattacttttgaaactttctgcacaacactcatgccttcaataatcatcatggcatcattgaagtttccttcttttacttttgaagttacaacaacaagttctgctaattcgccctctttgtttttctggataacctgagcaatacttacattattatttccaaatacacttgcaatacttgcgagtgtaccggcacaatccgatacatgcattcttaaaaagaaacggctttccatctcatctgcctttttcagaggaagctgtttatagcaggtgcagccaattcgtcccgtacattcaaatacaatatttcttgctacatcaaaaacatcccctgcaattgcactggctgtcggcaattcgcctgctcctcttccatagaacatcgcatcacctacggcatctccggttaaaaagactgcattaaaagaatcatttactgtcgcaagagcatgcgtctccggaatcagcattggacgtacgctgacttcaattccgttttctgtatttcttgccacacctaataacttaatcacacagcctaattcttttgcataacggatatcttttgcggaaatctgtgtaatcccctctgtaataacatcgtcaaatgtgactcttgaattaaatgcaattgatgccataattgccatttttcttccggcatctaatccctgaatatctgcagtcgggtcagcttctgcatagccaagctcggttgcaagggcaagtgcctgtgcaaactccattccctcctgagtcattttcgttaagataaagtttgttgtaccatttacgattcccatgatttccgtaatatgatttgcagccagacactgctttaatggacggataatcggaataccgcctgcaactgcggcttcaaataagaaatcacagttatgctctgcggcacactccaataattcctgtccatgagaagctactaaatccttatttgcagttacaacatgttttcccgcatttaatgcctctaaaatataagttcttgccggctcgattccgcccataacttcaattacaatttcaatggattcatcttctaaaattgttttccagtcatttgtcagaatttccggattttctaccttagcagatgctttctttaagttgcgcaccagaattttctcaacttctacaactgcaccgattttatgcggcatttcctctttctgatttcttaaaactttataaactccacttcctactgttccaagaccaagcagtgctgcttttattactttctcgctcacaatttatcctctttctttatcactttatttgttctctctttacgaatcggattttgcacatgttctacaaatccttttttcatttttgtatttcgctgaaacgctttgcttaaaccacccaacttattatatacccagaaagaatgtactaaaaccgtatttacctttccgattttctctttcgtcgttccggtatagtttgttccgccacattcaaattttgtacccttcatgatttctgtgattaaatcagattcacaggtaatatcatccggtatttctgtataggcaagtcccacacaatcctgtctgtgcgcatcacttccacctgttccggtcaacccatacttatctgcaattttctgagcttttccatttacttcctgtgattcacatgcattaaaagtttccatgaaatcaaattcctttaaaatctccggatttctctgataagcctttgcattcataaaactcatatatttttccccacatggatgcgccggtcctaagattccgccataattatgcacaatcggaattaacatctgaatcggcattccacgaagctccaaaagccgaagcttaatggtctccggcataataacaataatgtgtcctgcatctaacgtatcatactcaattccttttaataccagaaaatcttcatgctttttacctttaataaattttttccagtgccggtaaccacgataagaatcatggtctgtaaccagcattcccccaaatccattttgttttaacagggtaatatactcatcaattggaactttcccatcgatagaaccctcttttgtgtgacagtgcatgtctattttcataacaaacaacacctcctccgatttacctacacaatctcttttgtatctttctcttattctgcactcattccaaaacgtgccagtaaattatcaaaatgctgaagctgaacaaccagattgaatccataaggattaattaccataccaagtgcttccggcataataatttttttaatatttttaaaatcaatcatcattgcacgatatttgccttcacgatttaattttgaaaattcaacggtatcagtaaaaatcggaagcataaatttgtcttctttactttttaaatagaacacctttaatgcttcttttttctgttcttcttctgttttcccttcctgaggtttttcgactgcaatcataaatttactttttaccagattggcagccatctcttcttccagttctttaatattctctttttcttccattggaacttctcttcttaattcctgcataaaataagttcctgtaatctgcagtgccggattctcaagtggtctcttatcctctggaattttttctaatattggacgtttgacaatctctgtcagctcaaattctgttgtctgttctttttctacaaataccaccgcattgacgccaagcgtaaataaactggtaaaaaatggaagatatcctttattttcgatttttgccggaattaatttatgtttctgctctatcatataaggctttgcagcctctttcatatcatcctcgacttcaaatatccaaacctggtcattaaagttctccttatcacaaactacaaacgggttatgcgttcccgcattgataagcagatagaactgctccattttctgcagtttctgcaggctttcgattttgcttttttccatgtcttaagtctcctgttgtatttttcatttatcctttttcttttagtatacacccaaccatgaattttgtcgttatttttttataaatataaatgaaaaagaaccaaacagaccattttcgtccatttggttctcctctgttcttatttatttacatacttcttcgtaaagatttctgcccttagaatcaattactacgataaccggaagattttctacttcaagtttacggattgcttctgttccaaggtcatcataagcaataacttctgcttttttaatacattttgaaagcagagctcctgcaccgccaactgcggcaaaaaataccgcaccatttcttacgattgcatccgttacttcttttttacgttttccttttccaatcattccggttaaacctaaatctaataaacgtggtgcatatttatccatacggcttgcagttgtaggacctgccgaaccaattggacgtccttctcttgccggtgtcggtcccatataataaatcacatttccttctaattcaattggaagtttttctcctctgtcaagtgcctggtccatgcgaagatgcgctgcatctcttgccgtatataccgttcctgtaatatatacataatcccctgcttctaaagtttttacttcttctctgtcgagaggtgctttgatatgtctatccataattcttctattcctccgtattagatttctcttacaatatgacggtttacatgacagcagatattaattgctaccggaagtcctgcaatgtgagttgcataagtattgatgttgactgcaagtgctgttgtatctccaccaagacctgccggtccaagaccaatctgattgattttctcaagcagttcttcttcgagtgcttttacgtgaggaagttcagaatgaacaccgatttctcttgtcagtgctttctttgcaagaattgctgctttctcaaatgttccaccaattccaacaccaacaacaaccggaggacaagcgttcggacctgcttcttttacagcaccgataattgcttcttttactccttcaattccatctgccggttttaacatgatgattttactcatgttttcacttccaaatccttttggagcaactgtaatttctactttgtctccaggaacgagttcataatggataattgcaggagtattatcttttgtatttacacgctcaagaggatctcccactaccgattttcttaaatatccttctgtataaccctgtcgcactccttcattgactgcatcttccacgcttccaccttcaaaatgtacatcctgtccgatttttaaaaatacaactgccattccagtatcctgacaaatcggaatcatatcttttcctgcaatatcaagattttccaataactgacctaaaatctgttttgcaagcggttttgtttctttttcatatgcatttttcattgcctgtgccatatccggtgccagatagtggtttgcctgaatgcacatttcttttatgtttgttgttaatgtctctacatttactgtacgcacgattcttttctcctctttcttttacttcaattgatttttcacttcaatacggttaaaatcttttaaactttctccctgatgtttacccatcagaccaatcaacatataataaccggttcttggatctaccggatactcttttacaagtgtaaaatcttcgattttgcctgtactgcttacatgcatacgcggtcctaaacattctaatatccagtctccgatttgtacatgcttttcgtcataataagaaaccgataaatcttttgccactgcttctcttactttctcttccaatttatacaaatctacatccggtttttcttcaaattccaacacgaatccatgacgaacatccgatcttggtccatcctgtgcatacccatctcccataaaatgaacacataaatcttccaacgtatgtgccatttttctgtattttacagatttatgtacaatgcctgctatattttccggtaatggaccaaacatgcttggtctggtaataataatttcttccccaattccaactaacaagtctgcatttctgtgaagcaaaggataaatcaaatcaaaatgctccacaatcaccatttttccattgtttgctgcctctaaaattgcctctgccagttcatgcatctgggtaaatgcagattcaaaccgaatgtccagatgataagtgtgcggtgcaaacgggtctgttaaatcttctgataaaagcggaagcggacgaatattgactccctcatcatcatttgtcaaatcgatcccaggaaacattcctttaattaaaagactttttcctgctcccgcatccccgataatcccaataatatgatcaaacggacttaaatacatctggcttagctggattcctaaatctgtcattcttctactgcctcttggcgcaaaataaaaactgtacagatttccttcctgcatttgttttgaatatgccatatcttttccctcttaataaaaatagccagaccgccccaaaacaaacgcttcaggacagtctggcatctttttttctttaagtctccactacttattgcttttcacaattgaagcaggggactttcctgattcgattaacttcttgctttacgaagcgcaataattctttccatttcattataaacaatcatgtaaccttcatctacacccatacctggttttgcaagaatctggtctggctgtgttgccattgcgcagtttacgcaaacctgtgcagaacggtctgtttcattacaagtaccaccctggtaagctccaaatcctttttctttgcagtaaagaactgcttctacgatattattgattccaccaaggtccggtgttttaatctgagccatatgacctgctttattgtctgcgaaatattttacatcttctaatgtattacaccattcgtcggcaaccaattctacattaatgcctctcttatcaacttcttctcttaagccttttaagcaaagcatctgtttttctctttcttctgcatccatcggtccttcaattcttaaatggaaaggttttgcagcttcttcaagttctgcaagataatctgccatagcggtaaagttatctactccgaagattgcaccgattgttccatatacgtcgatatggaataccggcatataactttcatcatggcgaagttttaatacacgatctctcaaccattctacatattcttttaagatttcaccatgttcgccaagttttgtctttacattattgattaatgcatgaggcataacggctgcaccttttaaaatcatcttatcagagttatcataacggttatcaccggactgtgtaaagattggaattggtttatcagatacagttgtaccatattcgtctgctactacttcgcacatcagacgttttgtggattttgctactgcatcaagaatcgcctggctgacaccataacggattgctgtgtgaagtctctttccttctacctgaaggttttctaccatttcacaaagtcctttaaagctgtctgcttcttttccaaccagctccggtttgatatatttatcgataatcggaatgaaatcttctgcaaggaagagagggtctcttccgcctgctcctgaatactgaacggctgcacaatcaccccacgcaatctgtccgtcttcaaggattaacataacagagattgcttctcctgcctgtcttacggatttaaatcccggtgttacggtttctccaaaataagccgcaccatctgctactgcaccttttttgatggctctctggtcatcaaagaaaaatcctgttcttgcttttgagcaaactacatccacaattttcataatattcttctcctattttttatgtaaaatttgttttttgattttttctttgtctttatagtctctttgagactaattttggtatttcaattttgatatctcatctaacttaattttttggtttacctaccagacgtcctttactgattgcataaacatcatcgattgtcatctggaaagaagcttttctcttttccatttttgctctgtgttcgattttgcctctgttgaaatcagcaagttctcttggaagtggaacattagctacatttaagtaacgaactgcaccttcaaagtcacgagccggaagcatttttcctgcattgtatttacttggagcaaacggaatatcaagaactccggcttttactgcacgaacagcaccaagtgccaaatctcccattccaagttcaaagcatttatctacaatcgcacaagtttcccctttaatgattgctttttccagttcaagagcagaactctttaactcctggtcagctaacagagaaattgcctgcttagtacaacgaagaccctgtgcatttgcttccattgtcggaacacccattgcttcatgcggtgtttttacgataacttttgttgcttttgcaagtgctgctacagaacttccccatgaaataacaccaaatgcttttgcttcatcctgtgggaatccacccatccactgatgaagaacacttgttacaacaacatctgaatatccgtaacggtctaagtactcttctgtcaattcttccagtacacgaagtgctgcaacgtcctgtaccaggttaccgcactgaccatatccaacggttacatttcttacaccctgttctgccgcaagcagcgcttcgataatcgctactgcatttgacatggacggcggaactaatgtaccggttaatggaccataaggctcacggttaatcgagatacctgcttcttcatagataccggtcagacggtctacatactgccagtcataaatagttctttcaagcggaacatcttttgcataaggaatgttgtaagaaataccgccgccttcataactggtaaatccacctgcatagcagatttcagttaacagtctggcatctggagtaccatgacgaacctgaaccggaatatcaaggttttcgataatcgtacggcaaccggatacaccatggttgactgccggaaaaccatttaacatagatttctgagtacgaacagattctttaattccatcctcagcttctttataacgattctgtctggtataagaatcaatcgttgtcggaagtaaatctgcctctcctttatcctgcagatactgaagcagttttacatgttcatcaattaaagcgactccggctcttggctgaatcagagttcttctctctgcttttgcttttgccagtttctttgaaaagctcttgctttctggcattgctttatgataggcaacagattcatcaaaatcaacttcttttcctgttggccactgctctaaaatctctttgcggattccgtaaaattcgtcatccgacatttttttatttctcaagtccataataagcaatctccttcttcataatctccagcgcagcaagcggataatgctgagaaagcagtcccattgctgccagaatatactttctgtctatcaggatttcagccttttccggtcttaatgaaccaggcttgctctcatcaaacagtgcatattttgcaacttcttctgtatgttttgcatgaattaacgctccacctgttgcaaccacgtattttactcttcttaagtcttttccactctgtacataagtcagaccacaaggagtaaagacctgctccagcgaaccggagtgacgttctactgctgtttctactgctgcacaggcaagtgcataatccattttttccatttcttcattatccggtatgtaatctgtatgctgttccagccagcttaccagttcaactacacgatttttattgataccggaaattttactcagtctgcgctctccgacagcttctaaaataccctttacactgtaacgcattccgatatcgccttccaccgttcgtttggtataaggttccggaagcccttttattacagtggaagcatttgccggatttccatctgctacagaatagacatctgtggtcgcaccacccaggtctacaccaactaattcccctattcccggaacttcttcccatccatcggataacagctccattgcaacaagcattgcggatggtgtcggcatgataattccggaaaccaaatccattgcttttgtaagccctttgccctgcacaatccgattcagaaaaatttcacgtatctgtttctgcgtcggctctatattaatttctcccagttttggcattacgttttcgcaaatatagacagtacgtccttctaaaatctcttcgcactcatctgctgcgtttctgttccctgcaagcacaatcggacaatcatagcttaatcctgcaagcatttttgcattgtataaaatgcactcggagtttcctccgtctgttcctcccgataacaaaataatatccggatgataatcttctatttcttttaaatctccttttgtaagttcaaaagaatacgttttccatacttttgctccggctccaagagatgcttcccttgatgcctgagcagtcagctctggcacaagaccaattgaaaccatttttaatccgccggctgcgcttgagcaggcatatttttcttcaaattcaaggtgtcccgtggtctgttccagaatcttgattgcattttcaagaccttcgttaatatcggtctctacggttgtgtaagctgctgctgttccaagaatctcgcatgcttctacatcaaccgctgttacttttgtatttgtacttccaaaatccaccaacaaaatcggtttcatttttttcaccaccccgatgttatgctaataccgcttccggtttttctacttttaaatcctcgtataaagcagctactgttgtttccggtgctgtaccaggtccaaatacacggtcaaagcccattgctttgaaacgtttttccacttcatcaaatggctgttttccaactacaatatttccgcctacatataaaagaatatcttttaatccggattcatcgcatttatcacggagtccacggcaatctaattcgccatgaccgtaaagagatgaaactaaaattgcatccgcatttgtttcaattgctgctgcaatatattcttcctgagaaaccataacacccaggtttacgacttcaaacccagcttcttcaaacgcatgctgtaaaatgctgattccgacagcatgtacatctgcgccgattacgccgattactaatttcttcttatccattgtaaaaccgctcccttccggttatttataatgtattttttattgtatctaacagtgttccgtctctatataatacgtttgctactaccctgttgcctaattctaccttcttcggaacaccggtaattttctctgcaatttcttttaactcggtaatttctttaaccggaagaccggctttgattaatttttcttttaattctttccgttttggattgactgcaattcctctctgcgttacaattacatctatggtatcacccggtgtagatttgcataacacctggtctacgataagaggaagtcttgcacgaatcagcggtgctacaacaatggctagttttgcacctgctgctgtatcgcaatgtccaccggaacctcccataatgtttccgttggaatcagtgtgtacatttacattaaaatcagtgtcaacctgggtggctcccagaatgactacatcaagactgtccactgcagcactttttgctgccggagatgcgtaacgcatggctgaaatctcctgatgttttggattttcacggattgattcaatggcttttaaatcaaaacactgtacatccagaattgtatcaaaataacctttgtttgccatatctactaaatacccggtgataccgcccatacagaaactacctttgatatggtctttttccatcatttcttccacatattttgcaactgccagtgaggctccaccagcacctgtctggaaagaaaatccatcttttaaatatccggaattttttactacctttgctgcaagtgctgcaattctaagcccaactgggtctcttgtaatttttgttgttccggaaacaatctttgttgggtcccctatctgttctacttctaccacataatctacataaccttctgcgatggaagtatcttttaatggataaggtaccaaattatctgtcagtacgacaaccttatctgcatgcattgcatctgagaacgcatatcccatagaaccacaggctgatggtccatattttccgctgcagttacccatattatctgcacacggtgctgctaaaaatgcaatgtcaattttagaagaaccattttccatatctccggctctacctccgtggcttcggaagataaccggcttttccaagatgccctgcgaaatggcttttccgacttcggcacccatatagttacactcaagtcctgtaactactccatttttaatatgttcaataattggtttatgtacatcgaagatggaacttgcattgactgttaagtctttgattcccatactggctgcttcttcgagtaccatatttaacacatagtctccatttctcatgtgatgatgaaaggagattgtcattccgtcctttaagccagttttttcaattgcttctcttacggacgctaataatttactcatcaaacgcacctccgtaaattgctttttccatttcaagtacctgggaagcacgttttacaatcggtgcatcaatcatttttcctctaagagaaataactccttttccctgtctctttccttcttcaatcgcatccatgacatcatgtgcataagcgatttcttcttctgtaggagagaatacttcattaacaatatcaacatgtcgcggagaaatgactgcttttcctgcaaatcccagactcttggcaaattcagtatcttttctaagcccttccatatcctctacatcggtaaacggtgtatcgtaggcttcaattccacaagctcttgctgcaagcaccagtcttgttcttgcataaaagatttcctgtccttcttttgttcgcttacaatgcatgtcagccgtaaaatcttctcctcctaagaagattccaatgactcttttatctgcggaagcgatttcaaaagatttttccacaccaagtgctgtctcgattaacggaagaatttttacagttccctcttctattcccgctttcttctctacctctgccatgtatgcggaaacttcctgaatcatctcggctccgcttacttttgttggcataataacatctggttttaaaggaatgatggcctccaaatcctctttccagaattttgtatccgtcggattgatacgtacaactgtctcgcaggcatcaaatgactgatactttaatgtatttctgacaagaactctggctgcatctttttcatccggagatactgcatcttccaaatcgaaaatgatggtgtcagctcctaatgtatcaccattaatcagcatgtttggtgtattgcctggtaaaaataacatggttcgtctcatgattctaaaactccccctctttttaatgctgtctccattcgtgctcgaataacgcaatcgagtgcacctttatctttgatataaatttttcctgtagatatctcaaattcatttagtgtatctaccacagctccccgaatagaatccagatgctgattggctacaacagagtcaatttccagagtcagttctttgtcatctggttcaatctggataaacaaatcactggattccagggttcctgctactgcattttttaaaattttcacaggctgtcacctcttgtctttccctcttttttatctatgcttaaagcttaattttttattttgtgattattctacaacactttttgaaacgtcggccttggccagaattttctgttcgtgttcaattgcttttttctcaagcacttctacttcttttgttgtttccgctacaaatgcttcatctttgatggattccagattaatttttacattaaacagtgctccaagaactgcggttcttgccatcatagttgctactaaagcatctgttactgctgttttatttccttttgttaccattacttccgcataaggcataatctcataagcgcgttttgcaactgataacggtactgcaacggctgcttttaatccattctgcattgcttcctgacgagctgccttttcttcctctgtttcttttggcagtgtcagtgcctgcatatataaatcaaaagattcactgtctcttttgatgtcatctaaaagatgttcacagattgcatgcatcggttcgatggcagctttcatttcttcttctacttctgcatattttttcttgccaatggtaagacctgctaccatttcagttaacgctgctgctaatgaaccagcgagggcggaaatacttccgcccccaggtacaggttcatttgaggcagtttgcatggcaaattcttgaacggtcatatttttcatgtcaatacctctttcgttttactcttaattataaacgtgtttccagaacctggtcagttgtgaatttcgtttcaaatccgcagttgctttcttccaaattgttcagtcccagatagtatgctgcacagtctaccaatgcctgaagaggaacgagtccaataatctcgcttcccattacatttacaccgtagcgtcttgcttccatacgaacagtttcaaacactgtataaatagaagtttttgtatagtttgtaagattcatagatacctgagcaacatttttgcttgggtcttctttgttctctaacagaacgcccatagctttacaatatttgaatccacctttgatattacgaatcttatcagcgatcttctgtgcaatttcaacacttgatgtgcttaaattaatgttgtatgcaataagcggcattcttgctccgattacagttgcaccaccggttgggtgaatggtgcttggtccgatatccggagtccatgtttctggatcagctgcaattttttctgccattccttcaaactgtcctttacggattgttgcaaggtttgcactgtgttttaaaccttttgcagaatcttcatataagaagaacggctgaccgaatttttctgctgcttctgtagcaacttcttttgcaagtgcatctgcttcttctactgttgttccacggattggaatgaaaggaactacgtctacacagcccatacgaggatgctgtcctacatgttttgtcatgtcgattaattttactgctgttccgattgctgttaccattacttcttttaacggctctggctctccgattactgttacaacacttctgttatggtctgcatcagaagaataatcaagaagttttactccctctacatcacggaagcaatcgataattgcgtcaaatgtttttttgtcctttgcctcactaacgctgaaatttggtacacattcaatgattttttccattgccatagttctcttttctcctttataattatgtaaatatttaaaagttgccgttttttaaaacacacacttatttttatttccattctttgtgatatacagtctcgcccgctttgattacagtctcaaccaggttaattgctgtgtgatatggcatataatgaatggatgggaatttcaggaatatgatatctgcctgttttcccacttcgaggcttccgattttatcggctctgtccactgctgccgcaccattaatggtaagagcagtaatgacttcctcgattgacatgttcatataaatacatccaagtgccaccataagtggaatggaatttgaaaaacaacttcccggattcaagtcagaagccagtgccactgcacagccttcatcaatcatttttcttgccggtgcatattcttcttttaaaccaaatgcggttaacggaagaatggtactgatgactcctgcatccctcatctgacggattccttcatctgatgcttttaataaatggtctgccgaaactgctccaactcttgcagccagttcagaaccgccaagctggtaaatctcatctgcatgaattttcagcttgaatcccatttcttttgcttttgtcatatagtactcggaatcttctacagaaaatacatttttctcggtaaagatatccgcaaattctgcaagaccttcctcttttacaatcggcatgacatgatttaactgttcatccaaaaattctttctctttgcctttccattctggcagaacactgtgaggtcctaagaatgtggaaacaatatcaaccggatgtttttcatttaggtttttcattgcgcgcagcatttttaattctgtctcgcagtccataccgtatccgctctttccttctacggtagtcacaccaaattccagcatacggtttaagcgttcttcacctgtttccatcagttcctctaaggaggcttctcttgttggaactacggtggcattaatgccaccgccgcgttccatgatagacatgtaactgtcgcctttcagtctccaggaaaattcatctgctcgatatccgccaaagataaagtgtgtatgggaatctacgaaacccggcattacagttttgcctgtcgcatcgattacttcatactcatcatttatctgtttgtctaattcttctgttgtaccgactgccacaattttatcatcgtgaatgattacggctccatctttaatcagaccaatatctgacatttcttttccatgtttcggtgcactacctttacaggtaactaactcagatgcatgacgtatatagcgttttttcatgtctgttatctcctaattttagtgatgtgtatgatgatgtggttctaccactacatctttgcatactctttcaattaattcgtcgcttgcaaggtaaggcattgtaacataatcctgaccttctctgattctgttgtattctgctacagtttcgatagagtgttcgcatctgccccagcttcttcttgatacaccaatcatagtatcccacggaatagccgcttttaagatttcgtctactctttcgcttccgtcaagtaccataccgaatccaccgttgatggatttgctgataccaacaccaccgccgttgtgaagagctacaagactcattccacgtgcagcgtttcctgcgtagcaatgtacagccatatctgctgtaatattagaaccatcgtaaatattagatgtttctctgtatggtgaatctgtaccgcctgtatcatgatggtcacgtccaagcattaccggtccgatttctccatttcttaccatttcattgaatttcagagcaatatctcttcttccaagagcatcctgatataaaatacggcactgagtaccaactaccagtttgttcttttccgcatcacgaatccaaatccagttatctctatcctggcttcttctttctggattaatgatttccattgcagcgtggtctgtttttcttaaatcttccggttttccggataagcagcaccatctgaatgggccatatccataatcaaacagttctggtccaagaatatcttctacataagatgggaaaatgaatccttcgcttgtatcttcaccattctttgcgatatcttttgcgcctgcatcaaatacagctctcatgaaggagttaccgtaatcgaagaagtaagctcctctttctacgagtgttttgattaagtgataatgttttactaatgtctgatctactaattcacagaatttatctttatcatttgcaagcatttctgtacgttcttcgaatgtcagaccctgtgggcagtaacctccgtcgtatggcacatggcagcttgtctggtcagataacagttcaatcttgatattgttatcaactgcatactgcagtaagtctacgatatttccatggtaagcaatggatactgtttctttcttatccatgtattcctgtgcaactttgaatgcttctgctgcatcttcaattacaaggcttacccatccctggctgtgacgtgtttcaattctggaagcatctacttctgcgatgataccaacaccaccggcgatttcgattgcttttggctgagctccactcattccgccaagaccacttgttacaaacagatgtccggcaaggtcaccatcctgaggtactccgaggaattttctacctgcatttaagattgtgttgaatgtaccatgtacaataccctgaggtccgatgtacatccatccaccggctgtcatctgtccgtaggaagagcatcccattgctgttgcttttgcccagtcttccggattatcgaacataccaaccatcagaccgtttgttacgataactcttgggcttgttttatgagatttgaaaagacccattggatgaccactcatcattaccagagtatgttcatctgtcagttcttccagatattttttaattaactgatactgcatccagttctggcaaacctgtcctgtttctccataagttactaattcgtaaggatataaagcaacttcatggtcaaggttgttatcaatcataacctggaatgctttaccttctacgcattttcctttatattcatcgattggttttccgtaaattctttcctttggcatgaaacgatatccatagatacgacctcttgtcagaagttcgtctaagaattcaggagcaagctgctcgtgcagttcttccggtacatatctcaaagcattggcaaccgccagtttgatttcacgtttgttcagagtaagttctctcattggagctcttcttacgccttctttgaaggtcggatactccggcagaaccgggtccagtttgattaccattgcttttccgatttcagcattattcatcatttcacatcttctccttttttgttatttttatttgtttttgatttgatttaattttaccatttcaaagtctaaaaaacgtctatttattaaaaattttttcaaaaaaatcttgctatctggtaataaaatcgtcaacaattcacaatagcaaggttttttatcgtcttcttctatgaaatttgtcaaatttctacatcaagcataaagaatcattaaacgaatacaaaaagaccgccccaaggacggcctctttgcaaggaatgatatctatgactagatatggcgtggcatgcttccatccctgaaatcaaaaatttcagggacgaaagcttcatgctcaagaatactttcgtgctcagtatccatgaacaaatcccgtctacccaacggctttcactttttacgaataatggaatattcgtatctttactgtgactataccctaacataagagtagtcaaaaaaacgcaaaaaattcatatattttttaaattttttctaattcatatacactttttaatggttttaaataatattctgcttcttttcgatagtcctctgcttcttttgtcaaaagttttttgaatttttctgaatatttcttttttaattcccattcatgcaaggcgaaaagtccctttgcataaggggaacccaactgattggcacttttctttgcctgcatcagataaagcgaagccttttcaaactctccctttttcgcttcaagcagcgccagagcccccttcgcgatcgaacgtccaatcaacatataagattcttcatacaataaatctgcctgataaaaaacgagttcacctttctctacttctccaagttcctgataaaccctggcaagattgcagtaaacagccggtgtacacggaatatgattcttccggcaaactgcaattgcctgtttataatacgcttctgcttctttaaaatgtttttgttttctctgaatttcccctatgtaattataacatccggaaatattggacgcataaatccgttcttttaatggaactcttttaaaatattccaaagcttcttccagtttttcttctgcctcttcaaattttccaatcatgccataataaattccatacaatctgcaggtaatcgcatattcttcctgatatccctgtttttgtgccagtttgagactttcttctaaaagtgcttctaaattttctgtttcccagatattcagacgataataaatcagaaatcgtaaacaatggattttttcctttgcatcctctccaatacacccaatggattttaatgccttttcaatacattctattcctcgtctgtaatatccctgcggaatacaatactgcgcctgtgtttccattaaaatcgcatgaaaacgaatatatttttcctgctgcccactctcttcgtagatatcttttaattcttcttccagccggtcacaatattctaatacggattcttctttctcctgttttattccggacataaacagtgcaaccggataatgctcatacgacttataggcataattttgcaaagcaagaatcttatactctaaagttttttctttatttcctgcaagacaatagtgataaattaaacgttcaaaacgactggcatcataaatcggactttttgcaatatattctgcaagtttactgtgaaacactctacgccttgatggagacatctgaatatgtacataacgctgagtactttcatgaataaaataaaaacgaaccgattctttttcctgtttttcgtaaataaaatgttcttcttttaacctttcaattgcctctaaaatttccagttcatcctgccttaaaattgcaacaagtgcttccatgtcagaccatgcctgacaagatgcaatcagctctaataccttcctggttttatatggaagcgaatccagacgcatcttccagacctgagtcatcggcacaacctcgtcttcttttaaatccatgcccttataataatccaataatgtatgaattaaaaatggatttccatttgtctcttcgtaaatactgtttaagaatttttctgttacattctttcttccaagacgttctactaacatctgttctacattttttcggctgaagggcgaaacaaaaatttttgtaatctgtttttcctttacaagcaccgacagactcttctttaatctatcctcccagtttaccggacaagtacccagaataaacagatttttatttcgagaacgaatcagtaaagataaaaagtccagacttgatgcatccatattttgaatattatctaaaaacaggacaacctttatctgtcttccaagttcttcaaataattttaagatcaaatttctcgctgtgcggtaactataggaaatttcaacatcttcaaacagaacaatttcttcttttcttgaaaaaagtggaaacagctggtctgccgctcttaaatattctgtcggcagtgtcatatttttctctttcaaataagtatttaattccatcatcaacgtattccacgcctgaagtgtcatatttttttctgttgccagacaggaggtacgcataatcaatactgattcttcctgaatttctttcaaaaagctctccgccagataagtttttccaattccgctctctcctgctaaaaataccgtctcatcttcccctgctaaaaatttacggtaaattccacgaagcaggcaacgctctctctctcgtccatcgccttgtgtctcatcttccttatgctcgctttcactgacccagttttccatcagttcattgtaaaattcctgaatttcttttccgggaagaattccaagttctgtatgaagtttctccgacagctgctgataaattcggattcctttataatacaaaccttctttggcatagatttgcatcatcatcatataaatcctctcatcaatcggctctgcagttgtataccgttcaaataatttttctctttttttcagggaaagatgttcaacattctgcatcttttcgtaaaggcggttcaaataaatctcttttaattttccccttttgaaattcatccagtcttcaaacgcacccgcatttttcaaataaaaattttgcagaaaatctgatttatagacttccgttccgtttttctcattttcctctaaaaaacggtcataatcactttcaatttccagttcttgatttaattccagattttgtctggtaggtgatgtaatcagttcttctccgaacactttacgaatcgtataaagcgcatgacgtaagttttttcttgccgagctttcatcacagtcctcccataaaagcgttgcaatctggtctcttgtcgctgatttttccactgccatataatacagcaaagcttctacttttttatatggaaacatcatctcctgtttatttaccagcactttcggattttgaagtaccagtatctctatcatgatttttttcctttcttatatctatacggttttcactttacagattccggcttttgcagtcgcttctgcctcattttttaattctacaggatgctcccagtcctcgattactgcaagttctccggcactcacttcctgatttgcaatcttcatactgccttcttttacataaatacataacagattataatctttttctctttcaatcacagcctgctgtgcagttttaagctgtgcggtttccattacaccatctgctccatcttttaacatcagattaaaatctacgacctttccataactgacagtcggaattccaccgtcaaattcgtccacctgatacggttctaattctactcttgtattaacaccatgaatcaaatccaggtgtccttcaaaaatcatcagataacgtttcacatttggcagactggtaaactctgatttcacagcgtctacggtcgcactgctgattcttgcctgaaagtttctttctgcataatttccatcttccggataaatgtaaagctgggtggttgttccccctgaccagttactggttgaaaattcttctgctttttttacactcattttttcactcatgatttttgttctccttctctatcatccaagatatctttactataccgcaaaatttctgcggtttcaactttcaaccttgtcagccttcccaaaaatatgatacccttacataaagtatatgttatttatcaagggggatttttttatgtatctttcaaatacttatctcgaagagggttttccttttcatgggagaaagcaaaaacagatggaagcttttctaaaaaaaagcggtctgactccggactccttttattcctactccgttctcttaacagaccaaaacgggtctattttaggctgtggttcacgttatgagaatgtcttaaaatgtatcgcaattgacgagacttatcaaggagaaggtctccttgccaagattgtcacccaacttgtcaaacaggcagcacaatctgggatttctcacctgtttttatttaccaaaccttcctatcagacagtatttaccgacatgggattttataaaattattgcaactgataccatgcttcttttagaaaaccgaaaagatggaattgtacagtatttaaaatcagaagctgcaccatttttggctgtttcttctgatgtttcacatcctgtcagtgcaattgttatgaatgccaatccatttaccaaaggtcatcaatatctggtggagacagcagccaaaaaaagcagtctcttacatgtatttgttttatcggaggacgcatcagaatttccatccgatgttcgtctcgaacttgttaaaaaaggctgtagccatctgtctaacgtctctgtacatggaagttccgattatctgatttcacacgctacttttccggattattttttaaaagagcgcgctgttatcaatgatgacaccgcaaaacttgacctcgaaatttttgcacattactatgcgcctgcctttcatattactgcacgttttgtcggagaagaacctttttctaaagttacaaatgcctataatcagcaaatgaaaacgctccttccaaagcatggcattgatgtctttgaactgccaagaaagcaaaatgatgacaccattatcagtgccacttttgtccgcagactgtttcttgaaaatcagctggaagcattaaaaaattttgttccggcttcaacttacgaatacctggtttctgaagccggacaaaaacttcgagcttctctcttgtcacaaaaggagggcctataagatgtcagatttacttaataaaaactggagtactggagttccaattaccatggctgaaattctcgatgcaagagaacaccgtgcatggattcaacaggaactgctttcagaccatactcttgaatcaaactgtgccttaatcagctttactttaaatattcccggtccaataaaagtatttccttataccgtttgggctttttatgagggaattcattttatcgaatcctgtttaacaacgcatcagcttacgttattaactaaaaaaatcatggaagaaaataccggatatgaagcattttttctaatcaaaggaatcactccggaaactttaaaatcctatatgactgcatttgaagatggctcttcttttggacgtatctttgatttggatattttgcgtcctgattctaccaaagtatcccgcactgagcttggactctctgggcgcacctgcctactctgtgacaatcctgtttttgtttgttcccgttcccgcactcattctgcaaaggaactttccaaaaaaactctttctatcattgaagcgcatttttttgaagtgttttcttcttatatcggaacacagatgacacaggcactgatttcagaagtcaatactaccttaaaaccagggctggttgaccgctatcacaatggttcccataaagacatgaatcgggaacttttcttaaaaagtgcagacagtctgtttccttatttctgtcaaagtgcacgccttggtctggaagcaggatgtcttggcacacctcttcctgaagtcttttcttctcttcgtgtacttggattagaagcagaacagaccatgtatcaggcaacaaatggagtcaatacccataaaggagccgtcttttccggtgggattttatgctgcacccttggatatactgtttcaaagaaaaccataccttctctttcttttttggatgatacaacagacgagttgtcagaaatcatcaaagaaatgttagttcatctccttgatgatttgaaactgctttctaaaaaagattctgcctctcttactcacggagagaaactttatttgaagtatcaagttacaggaatccgtggagaagcccaaaaaggatttccttctttagttcagcttggacttccactttacaaaaaacttttacaagcaggtttttccagaaatgatgccggctgtattttacttttgcactatattgcttacacacaggacagcaatttaattacccgctctgattatcagactgcacaaacgattcgtacacagcttgcctcttttttagaaaacagcagttacgaaaaacagcttgaagttcttcctgtaattgataaagaatttgtcaaagcaaatttaagtcccggcggaagcgcagatttactagccttaacttattttttatatgaaatttatcataccactattttattttaggaggtttatgctatggattttactatgcaaaatgccacattagaagatttaaacgaactaagcctattaatgaatcaggcacataagacaatggagcaccctgaatggtttgctgccgatgatgatgtttatttaaaaaagcatcttgaaaaacacggatttattgtcacagcacggacaaaggataaaacactttccggtttctttgtcattaaatatcctgctgtttcagagaactatcttggacagatactgaatttttctgatactcagatgcagcagacagtctatatggattccgctgttgtctctcctgagtttcagggaaatcatctgcagtctcgtatgcttcaaaatgccgaagcacaattaaaacatcagtttcatcattgcctgtgtctggcaaccgtacatccagataaccgattcagtttaaataatatgctgaaaaatggatatgaaattcagttaactgccacactttatggcggactgccacgttacgtgctgttaaaagaattatagtgaactactcggcaactaagttagcagagcatctaaaaaatctgcgcagagcattgaaacatgttctgcgcagatttcttttttattttaaaatttttaattcatattctctgcttcccagaccaattttttctgcctgatccagtgttgctttccactcaatattcggattggaatctttaaagtggtcgtgatggcaatgccagtcttcctgtgaaagatgttctccaagctgactgttttcaattggttttgcctttaagcaggcatccgcacatgcctgatccaatgcaaccgggtcaaaacttgcaaacattccgatatccggaagaatcggtgcatcattttctccatggcagtcacagtttggactgatatcctgtaccagtgaaatgtggaagcatggacgtccatgacagactgcctgtgcatactctgccatcttgcggtctaacaattcatttgcactgctgtttggattataaacggcatcaaaactacatgcaccaatacagcgtccacagcccttacatttatcatagtcaatcactgcttttttattttcataaataattgcatcactgccacactcttttgaacaacgatgacatccgcggcataactctttattaattgccggtttcccactggcatgctgctgcatctttccggcacggcttccgcatcccattccaatatttttgattgcaccgccaaatcctgtcgcttcatgtcctttaaaatggcttaagctgatgaaaatatctgcatccataattgcacgtccaatcagggcagttttacaatattctccatttacaaccggaacttccatttcatctgttcctctaagaccatcaccaatgataatctgacatcctgttgtaacactgttaaatccatttagatttgcgcagtctaaatgttccagtgcattttttctactgcctggatataacgtattacagtctgtcaaaaatggaagtcctccctgttctttacaaaggtctgccactacttttgcgtagtttggacgcagaaatgccatatttccaagctctccaaaatgcattttaattgcaacaaattttccttccatatcaatgtctttgattcctgctgcaatacaaagttttttcagtttgtccaactggcttgtccctaccggacagcgaaaatctgtaaaataaactgttgattttgccataattgcctcctttgattttatgtaccatcaaaatcttttttgggaaaaattataagaacttatttctcagagtccattctttccagcaaagatttagcatccagtctttgtatcggaattacttcttttggtggattttcatgttttccgagcattttttccatccatatcatatcataccatttgccaagtttgtacccacattttgtaaaattcgaataaatctcctacaataatagattcaataaaccaataacaaatccaatcagtgctccaaggttgattaccgtatgaagttcttttttcataatactcattaaaatattttctacttccagtacatccatctggtttactttttcttctaccacttctgcaatatggaactgttcggcaaatctgccagcttcctcactgacaaatttttcatataccgcttctactaccattccaattttttcttctcttgaaacaagccctcccagtacctcactgactggtctttcttctgctgcagctatttcaccaactacaatcggatggattttttcctgaccattttctttaatatattcgcccactttatttccaatcggctcggcaatcgaatgaattaaatcatcatttaaaaacatggacaccatagaaccctcaaatttcttcttaacttcttttgcgccctcttctgcaattacctttccgacatccattttatcgagtccatctaaaatccgcccggtaataaaatcttctaatttctttctcgtctcattatactgttctgattctacataacgcagtaaaaatgtctctatcgtttcatcactctctgcaatttttcgtacttcttccttgacacggcttactactgcctgcttgactccatctgataacagcatctgttctaaatctttttttgtcagcagatgttctcctactgcacttccaagtgctctcgccagacgcgcttttcctcttggaattacacctggagtaaacggaagcgtccagttcccgattttaaccggatgcaagggacgaaacagcatttttaccgcaaggtagtttgtaaaatatccgatgacagctccaatcaacggacctgacagtatttttaaaatatgcatcaatattcttcctcttttttcatcttaattttgttttccaaataatttatttctcaatttttcccatatctgtactaaaaaatactcgtaagctttatcataaataaaaagtgcagcctgtcctcccagtattaaaataagcctggctttatctgacaattttccggcaaaaaacagcttcggtgcaataaaaagtgccggaagatagagcagattaaaaaccaaaacctttgacaggttaaaataaagctttctttgtttccagtccggatgcattccaagtatccgaaataccgcctcaattaaaacaatgtaacctcccatcaaagcaaaagtaatacaatgcagtttttgaggggtaaaaagcaaacttaaaatcacacttccgataaaaaatgcaactcccgtttttagtccgtattcttttatgataattcctacacaaaacgctgctccggcaagtaaaaacaaggtattggattccaaaatccctccaaaacacaccagcaaaactgtcactgccattaaaatacccgaaacagccattttttttgcatttatatgcatgaacaaaggtctcctcccatacattcacacagactatctgcacaccataaatcgcaacagaaatttccagttccacaagcacttccactgcccgctccataaggatttcccattccctgataacgctgcgtattccactgaagacgatttaccagattattatattctgcatttccaggttccatactgaccgcctgttttgccaaattcaatgcattcatattgtttccaagtcccatattggcaattgcacttaaataataccagtgagctcctcgatttttcatgccagagagtacatttaatgcctgttgatactggcgtccatttaagtaattacttgctacctgatactgacgttgttcttcttcagaagctccctgatactgataaccggaattctgctgataagaaccactctgatatccgctttgatatccgccgtctctttctttcataatctggtcataagcttcctgtacctctttaaatttttcttctgccaaatctgcaagcggattatccacataagaatccggatgatactttctgcttaaatcgcgatatgcttttttcacttcatcattggaagcatttggagaaattccaagcacttcataaggattatttaacatttttttccttctcctgtttttctttctgaattttattataattagaccatacacctgaatagatgatatttttaataatctggctttcctcaacacatggaagatgttcaaaggcatttccggtctctgccatcatcataaccagcatttcacgtacactgttttcatactcttcttttgttcgtgaatgataaaacggttttaatggattataacttccgttctttaaatctttttccaagtcatcataagcatccataatataaataaactttccaaggaagaaaccaaactttcttaaatacggttcccatctgtcttgtttcaaaacaaacaattcttccatcagatgcccaaaagttccggctacaaggtcaatatctgtctctcctttttgttcatatacggcaagttctcgtaatctcttacagatgacacggctctgccttggatattccttacagattttctttgcctgctttttatagaaatggattcccgcaattccttttaaacttttttcatccttccagtcatcttcaaaatgataataggtcaataaaagattcatatctgcaccgtatcttgaaatttcattttgcaaaaccggaattttttttatcgggtgtaccggacatctcgactcgcttttttcttctttcggttcatataaggaagtcaacaccaaaaccagaaaggtaacgtcataactaagtgtcactcttccctttaatccataattctcttgaagacttttgcaaagcccgcagtaataagccttatatcgataaaaatcttttactttcatctccggcttatccactgtaatatatccaaacatagttttatctgcctttcttttctttcgacataatctttgttattatactacagattttgaaaaaaagccattctattagatatctctgatagaatgacctccctcttattcgccccgtaatgttttttcagtgaatttttcaaacaattccttgttcgcctcataatagtccattttattctggtcttttttcagtttggtatcttctaccaagcgcagtgctcccatcaaatcacctaactcttttggacttcctgcttcttcataacccgtacaatccgaaaactttatatactctgattcatctgccggaagtacgccactgtctttatagctttcataacatccaggacttaaaaagaaaatcatactcgttccctcctggatatctaccgtaagttttgtctgtcctgctgcaaccaactgagggtctgcactgtctccctgtggaattgtataattctgcatttcaacgtgtatctcaccatctccatttaaatcttctgcctctttttcaagcacactttgaatcgaagagatttcttcatccgtcatcatttcctctgttacaaatgccacggaatagtcataatccacttttgttacgatatctttgataaaaacacctgcaacaaataaaataaatacaacgaccagtacatggattttgtaataataccagaaattatctatcttctttctggtttcctctttcatctgtggtttcttcatacttatttggtccatcctttttttatgctgattacgattttagcacttctgccgacttatgaaaagtattttccttatatctttattttgtttttagactttcttcacatttccttacttttctcttgtatccagacatccaaaagcgttataatttatgaagttttatagaaaaaggagttatctatgaaagatttaacaaaaggcaacccgacccgcttaatgctttcgtttgcccttccagtctgtcttggaaatatttttcagcttttttacagtctggcagacactcgaatcgtaggaagcacccttggaaacgaagccctcgcggcaatcggcgcgacaacggcaatcactactttattaattggctttttacagggactgaccaatggattttccattatcgtcgcccaatgctttggtgcaaaacagactgaccagctaaaaaaagcttctgccggcacttttttattaagttttatcacaaccatccttttaacggcacttgctttactcttcctaaatcctctgctgcatcttttgaatgttccacaggatttatttgattctgcatctgcttatatccgcatcctgcttatcggaatgttgattactatgctttataatgccctcgcaggaattttgcgtgcagttggagataccgttgcaccgctgttatttttaatctgtgcttctttattaaacattgtactggatttaacctttattctggtctttcatcttggagtccgtggagcggcttatgccaccattttatcccagatggtttcggttgtgctgtgttttacttatatgtggaaacgctatccgattttccatctggaaaaagcagattttcatcttgattcaaaaatggtgaaaaaactgtactcctccggtttttcgatggcacttatgatgtctctggttttctttggaactcttgccctgcagtgcactatcaatacttttggaacagatatcatcgttgcccataccgctgcaagaaaagtaacggaatttaactttttaccgatttctgttatgggaattactatgtctacgttttgcagtcaaaattttggagcaggacagtttaaccgtgtaaaaacaggaatccgacagtcactgcttttatgttggctgtgggtgcttgttattatttttctcgcttatacctgtgcaccattttttatttatctggttaccggaacaaaagaaaccgccgtcacagacccggcttccttatacctaaaagtaaactccctgttttactttgtatcttccggaatttccatcttacgaaatggacttcaggcaatcggcgaccatattactccggtcttttcaagtttaattgaactggtcggaaaaattttgattgcctttttacttgcaccagtacttggatatatgggaattattattgccgaaccgattatctggtgttttatggtaattcctttgattgtaaagtttgtccgcaccagtcaggcgtatcgggtatgaaccccttctatccctctgcgtatactaatatcgaaagcaattcttaggagttttcattttggcaacaaagattgtaattgacgcaggtcacggcggcagtgttgaccctggagctgtttataaaggaagagaagaaaaaaatgacaacctgaatcttgctatggctgtcggtaagattttatctgaaaatggagttgatgtcgtctacacccgaaccgatgatacttatcagaccccttttgaaaaagcgcagattgcaaatgaagatggagctgatttttttctttcttttcatcgaaattccagtcccatgccgaatcagtattccggagcagaatctctcgtctatgatttatcaggaacaaaagcggaacttgcaaaaaatattaatggtgcacttggcgagcttgggtttaaggatttaggagttagtgccagacctgggcttgttgttttaagacgcacccgtatgccggcagttttaattgaaacaggttttattaataacgattcagacaatgctctgtttgatgaaaaatttgatgatattgccgaggcaattgcttatgctattcttggcacacttgacgaaacaaagaccgaagaaccggaacattcttcctctgttctatatcgagttcagaccggacaattccgtcaaaaagcaaatgctgataatcagctttatgaattacaggatatgggctatcccgcttttatccttgaagaggatggattttataaagtacaggttggggcatttcatcaattagaaaatgcaattaaaatggaacgcagactgcgcttggacgggtattcaacctggattacaacacgataattttatttgacttgaatatttctcaacaaaaatggatgccggaaaaccgacatccatttttatatttattcaaatcgaaacttcaaatacacagattacatagattctgcacgttcctggatattctttttaaaattaatcacttcatgtacatattctttatccataaattcagagtgaatcataaaatctgcggttgccttgctgaccgccatcggaatatcataaacctgagaaattctcatcaatgcttttacatccgggtcatgtggctgtgcagtaagcgggtctgaaaagaatacaacaaaattaatgacgccctctacaatttttgccccaatctgctggtctccgccaagcggaccactgttatagcctttaatcgtaagccccgttttatccgcaatcaatcttgcagttgttccggttccgtaaagattatgttttttcaaaatatcatagttttctttacaccattcaattaactttggtttttcattatcatgggcaattaacgcaatgtcttttttctcgccgattgtaaatttgatgtattcattttccatgatagtttcctcctaatttttatctctgtcaattatatcatgtttcacttgttctctcaataagaaactgctacaataagtgagaagacagaagcctttaatttgacaagaaagaaggaaattcatatgaaagtactgtttttaattttactgtttcttgttctttgtccggcactttatttttactgtattatgccacgttttaccagaaaagaacaaaccaagcgttttgcccatcagctctttgcccatcgtggattatttaatccaaaattgggaatccctgaaaattctatgccggcattttcacgtgccattgaaaaaggatacgggattgaacttgatgtacaggttacaaaagataaccggattgttgtttttcatgattattcccttggccggatgtgtggaattgatattccgcttgaaaccaaaacttatgcagaattacaggagctctgccttcagaataccagggaaaccattcctcttttaagtgatgtcttaaaactggtaaatggtcaggttccacttttagtcgaaatcaaattacattctttccatacatacccttgcgctctcgtggatcagctattacaagaatatcatggaagctactgcatcgaatcctttaattcacttgccttattgtggtatcgtcgtcacagaccagaggttgtccgcggacagctttcttccaatctgaccaatcctgtggcagaaggtggatttttattaagttttcttgtaaaacatttgttaattaattgcattggcagacctgattttatcgcttattcctataaagactataaaaacttaagctttactttaaataaatgtctttataaaacaccggtttttgcatggactttgcgctctccggaaacatttgaagcttctaaaaaacgcttcgattccttcattttcgacagcttcattcccaaaaatgaatgatgtgtaaatgttttctaaatttaacatgaaccccattgttattggaatttgactatgctataatgtcaatacttaatacttggagaagaggtgaatttcatgaagctattaaaaaaataccagcatgtttggattgtacctgtatatggcattttttatttatgggcttttcaatatctcgaacagcgcaatgtaaaagctcatatcattcatttaaaattagatgacatgattcctttctgtgagtattttattattccttatctaatgtggtttctttatattgcattaaccgttggttattttgctttcatcaataaaaataagcaggaatattaccagcttatctttacattaggactcggaatgacattgtttttagttgtttcctatttttatccaaatggtcaggatttaagaccacacttaaccggagatggattttttatcagtttggtacggcatctgtaccggattgatacaccaactaatattttaccaagtattcacgtgtttaactcagttgcctgctgtatcgcaatttgcagacataactcctttaaacatccacgtacggtaaaaatagttacattcgtcttatccgttttaattatactggcaactgtgttcttaaaacaacatacgttaattgatgtattttctgcatttgcgctgaatatcgttgcttaccagatgttctataaaccacatcctgtccgtcagaaacagccggaacagatttttttaaaataatgacaaacaaaaataagcaagagaactgtatcatttacaactctcttgctttttcttttaattaaaaatctaattttaaatctaattaaatccgtaaaatttttgtgctacgtgatataccgcaataataatatttcttccacctgctcccggaagattgactgcccttcctaagattccaagtcttaatttactataaatatttatatctgcatttttaatatatttccataaatctttctttttgttcaggttttcttctgtgcctgaacgaatcagcataacagaagaaacagtcgtaatgatatccagatatctcaacatatactgtcttaaatgtttatttgaaattttctttccggcaatggtatctaccatcagacgattcactaacaactgctggtcaatcctgcgaatcatgacgtcctcatgtactgactggtcttcacgtccgataaaataacgatagaaattttcatccatataatacattgtttttacggacattaatggctgatacacaaacaggttatctacataaaatgtatgttttggaagttccagtccacactctcttaataattctgtacgataaataacagaatgcattaagatatattttccgaccggcatattcgacacttcatcccatgtaaaaatacgattctgaggaagatatttacgataacgcatgattttctttcgttttacgccctgtttttcatacacaaaattgctaatcatcatatccagagtctgcggacctgcaatcaattcctgcagttttttcaaaattgcctcaaaggcttcttcgttgacccagtcatcactgtctactactttaaaataaaatcctgttgcattgcggattcctgtattaacggcttctccatgtcctccattttcctgatgaatgactcttacaatggtcggatacttttcggcatattcatctgcaatctttgcagtatcgtcttttgaaccatcattaacaatcaaaatctcgacaagttctcctccctttaataatgaatcaacacaatttctcatataatcctgtgaattataacacggaactgctattgacagtaatttcataataatctcctttcatccttcatctggcatttgctgtattttcattctaattttttatccatatattttttgtataccgagaatgcagatggcatcggatagttttcagatgcttcttctttatcaataaaaataaaatctttgcttttttttagctctgtatcttctactaaaataaagtatccctgcatctgccattccacatgtgaaaaaatgtgctttgcattttcaattttcttaatctgaatggggaccagattctgtttttctacaaaaaaaagcacttctttttcagacagaaatccctcctggttcggaaactcatataaccctgccaaaagtccctcatccggacgttttctaactgcaaaatattcttgcttctgaatcaacagtactgtctttttttcaattctccgctttacttttccactcttcttcggatattgttcaattgtaccatgtttttttgatttacaacagtttaaaatcggacatttttcacattttggcatcccattgggcagacagacggttgctccaagttccattaaactctgattgaattcaccgacatcattttccggcatctgttcttctaaaatatactcagctttttttttcgttgacgtctttgcaatatctttttcccactcttcctgccttgccagaacccttagcacatttccatctacggcaggctttctgactccaaatgcaatcgacgcaattgctcctgccgtataacttccaattccaggcaactccagaattttatcgtaatcagaaggcatttctccgtcatacttttctacaatgacttttgctgctttctgcatatttttgacccgattataatatcccagtccttcccacaacttcaaaagtatttcttcttcacactctgcaagtgcttctattgtaggaagtttttctaagaatcgcgcatagtatctctttactgcttctactcttgtctgctgaagcataatttccgatacccagatatgataaggagtcgcatcttctctccagggtaggctccgtttctcttttttgtaccattcaagcagtggctttgctctgttttcaaacatttcagtttctcctaaaaaacagccagaaacttatctccaaccgttttatatttttattcattctctacttctgtcagcttttcataaatttcttttacactgtcaaagatatagtctggttttatctcaccttccaaaatatctttcatttctgcctctcctgataaaacacaaatggtatctatctttgcattaattccggttttaatatccgtataaagccggtcaccgacaatcactgcatcctccttatcgacacccagctttttcaatacacagtttaccataatcggctctggttttccaataaaaaacggttcttttcccgtcgcattttttagcataatgctcatagaaccacaatctggaatatacccaaaactaaccggacaaactaaatccgggttcgttgccagatatgccacctcttttcctaacataatgcaggtatttcttattttttctgacgtattctccgtatcaaacccaattaagacaatacttgctctgtcatctgcttctgttaccacttcaattcctgcactccgaagttcttccactaaagactgtgttcccatacaatagacaatctgtcccggataattttctttaatataggctgctgtcgcctgactcgatgtataaaaattttcttcgtccgcagaaatccccatgtcattgactttttttacatagtctttcaccgattttgaagaattatttgtaataaaaatatactgtgctcctctttgtctgatttcctctaaaaattcaagtgttccatcaaaaatttcattttcattataaatcgttccatccatatccaacaaatatagtttttttgattttaaacgttctgctgttttgcctgttttatctttcaatctgctcgtttctccatttttttctatcctattttaccagcttaccaaaaaagaagcaaaacgaatgaaactaaaatttaaagagtttcgtccgttctgcctccttctattttttaccaaatttaaaatttcactttaataaaaacataatatcgggcatccagcttcaatattttcataaagttctgatgccatactgctcggaaggttgacacatccatgagaaccgctgtacataaaaatacttccgccaaaggaatatctccaactggcatcatggaatccaattccaccattaaacggcatccagtattttacaggtgattcatattcataagtgccatctgcccttcttgtacctcttaatacctggtctttttgcttatacatcaaataataagttccagatggagttcttctatcggaaactgtataagttccagaaacaaaatcggtatccatgataagcgttccttctttgtaataccataaatgctgatttccaaggtcaacttccacataagtatttccaatatcatcacctgtcatactataaatagcagctcttgatgcataagccggctctcttgttaccacatcatgattcacaatattttcataaatctgctctgcttcttcgctctgatcaattcgaaatccatagcttccgccactgactgtcacaggctctccggtcatcgtgcttgtaattgtacggtcacgtcccatcgtgtttcgtcttgtcgccaagtctaaaacatattctttgatatgtgccatgactgcctctttattttctacataatttccctcttcatcatagcttaaccagtctttaatctgcataccgtctaatacttcctgctcatcaccaaatgtatatgtaatggttgcagttgcacaactgttccagatatctttttgatgaatcaatgtttcatcatcttttgtcacactcggttttgcataagctcctgttttttccactgacagctttgtctgacttgtacaaacagcttcttctaatgccgtaagcagcgttccttcgtcaatggttgttccctgtgtctcatcctgaatcacaaactgattgtccacaaacgcaatctgtgcatctgccggtgcctccatatttgcctcctgcaggcaatccagaccatctaactgcgctttaagcgcagttttgtcaaaatttgcatcaatctcaacattataatttttctttgaaaacagaccacttacccataacagcggattttgttttttcattacatcttttacatctccactgcctatatactgatatccgatatcactgcctgaaatcgttctgctttcattatttctgaaatccaattcaatttcgtaagactcaacctgttttttcaatgccgcatctgcttttttctccgtcatattggcacagtccattccattgattttactgcctgcaaacaaatgattggtataataaagcgctcctgctgcatatcccacaaccaaaatagctgctgctgcacctgcaatcatcgaaggtttcagtttcttttttgcgttacctgtctcatcagaaatttcggaatctactatctgttctgctgttaccggtattggctcaactgctatagcggaagccactgcttcttctgaagatggctcttctgaaggtgattctttgaacggttcttcttcggatagttgttcttctttgacatattcctcttccttgagagtgctttcttcctgttcttctttttctacaggtacttcttcttttgaaatttcctcttggtttacgttttcgtcttcttgttttgcgttttcttcttttccggcttcttccttcgctgaaacagcttcccttaccgcctcttccttggaaatttcctcccctattgtttcctgaatgattttttccattgcagaatcaatctgtttttctatttcaggattttcaccagcatgttgctgtgcctgcttttgtttttccattgcccgtttttttgcagcttccacttttcttcttcgggcttctgaacgaaacggctgctgatttttattcttttttgttgtatctttcattatctactactcctgcaactactacttttcttttccatccaaattcgacacttgtacattataacacaaattttcctttattggtaaaattaacgaaacctaaataaaagttaagaaatttgtaataactagcgtatcagaaatagtaaagcaacccttttgattttttgccatcctcgaatgcttatctgcagtaaagcggacattcgcaatccgcttcgctacttgctcatgaacgcagtcgctttgcgatctgtcagtgggagctttcaactcccactgacagaagcatccccctcacccgccgcttagtgctctgcgcacttgaagcgggggaatgcttatctgcgttcaaacacccttagtataccacaaaaggatgccatattcacactgacatccttttctttttctttactttttttctttacttaggcttctttaaacatcattctgaaaatttttcttaccagcggacctgcaaagaaaatctgccagcagagtgccattgggaagtttaatgcagtcgtttctgcccataccgcaattatatctttcccggcatgtttaaacaataacgtagctgcaaggctcatgcttggacacatcaggcatactgttaccgctgaaattgcaagcacaatcataatctgcgcatcttttcccggtgttacaaatccaaatgcaattttttttgataaaaatccaaataagaagaagtctaaaataaacgcaattggtcccataatcactaattcatgaaaagcaagtaaaaagacttcatttgtcattccacctttgttaagcgcaatgttatagataatcattgcataaaccataacgaacaccatcataattgtaaatactacttcctgaaactttgtttttggcataattttaattcctttctctcgttcaattctctacaaaaaatatataaaaacaaaaaaacgtgcagttgcaaaggattttgcgatcgttttgcaactgcacgtcgtggttctattataccaaaactttatgcactatataatactttaagttctacaaactttatgtgaatttttctaatttcacatacaatttgcataataatactgtttttttactatgcaacatgaaatgcaacacaaaataaaaaaagtaccgtaaatacagtacttttaaagcaggggatgagggattcgaacccccatcgacggttttggagaccggtgctctaccattgaactaatcccctatattctttttttaatacatttccttaacacgtttatcattatacaataaataatctgttattgcaagctgttttttttattttttgaaatgtaccttcaaaactacatatacaaaaccgaaaccatgcagacacttgccgctccactgatttctcagcttctggtcaagccctcgaccgattagtagcagtcagctccatacattgctgcacttccacctctgccctatctacctcgtcgtcttcaaggggtcttacttcctaagaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctcctagtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctagttcggtccgcatcacgcttttggattgccacacggtttttcctatgtgactcctccttcgcttgccccgggattccattcccgggttgtgctctccacacgtgtccccacagttctgttctaacgcagtacaggaatctcaacctgttgtccatcggctacgtctttcgacctcgccttaggtcccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtatcaaatacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgcctttagcgcttaaccttgccagcatgcacaactcgccggaccgttctacaaaaagtacgcggttccgcatataaagcggttccacagcttgtaaacacagggtttcaggttctctttcactcccctcccggggtccttttcacctttccttcacagtactatgctctatcggtcactaaggagtatttagccttacggggtggtccccgctctttcccacaaggtttctcgtgtctcgtggtactctggatcctgccttgtcctctttcctttcccatacggggctttcaccctctctggctggctttcccaaaaccattctggtagaatcaaggaatcaattccgcagtccgaaccccagcatgcacgcacactggtttgggctctttcccgttcgctcgccgctacttaggaaatcgagttttctttcttctcctcagggtacttagatgtttcagttcccccggttcccttccatacgttatggattggcgtatggatacatgaggtcttctcatgtgggtttccccattcagacatctccggctcattggatatttgctcctccccgaagcttttcgcagcttatcacgtctttcatcggctcttagtgccaaggcatccaccctgcgctcttttttgcttggccattcagatcttatagcgttaacatctgacggctggtgttgcttggtttgtttctttcttcatcgctgtatttctacagcgcctcgtttcgtctctatcttacgttttacgtattttagatgtttcgtatatgcagttttcaaggtacattcagatgtaagtttttgtaatgccatgaccggcagaactttgttctggaggctgcgaacatcacactcactcttattcatctttcggctgttttatcagccattcaaacacaaaaatcttttatgcttgaatcactaataaaaccatgattcttttttttgtaatccggcagccacctgcttttccatgccgtctccagcatagtatcatcggccgcttaagtcttaaccatcgtgttcgggatgggaacgggtgtctcccctaagcgcatcgccaccggaaatgttttgttattaaattttagaagttttccttccttaataactcaacagtgaaacacttacgactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgggctcgcttccctttgtttacgccattgtagcacgtgtgtagcccaaatcataaggggcatgatgatttgacgtcgtccccgccttcttccaggttatccctggcagtctccacagagtgcccagctttacctgctggctactgaggataggggttgcgctcgttgcgggacttaacccaacatctcacgacacgagctgacgacaaccatgcaccacctgtcttctctgtcccgaaggaaaggttccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggcactcaagaaaaacagtttccaatgcagtcctggggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgagatacttcttccttcacgcggcgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacactgtatcatgcgataccgtgcgcttatgcggtattagcagccatttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactacttggctatctatcccttttactgttttggttcattgaaccgttctttttaaaataaatgaatgtaaaagaattttcgtttttatgtgtttcactgttcagttatcaagcttcctgtcgttctttttatcagcgacagcttttatattatatcaaagctgtttttgtttgtcaagaacttttttaacttttttcaaagttttttgttactttcgaactttttaactttttgttgcttttatttcagcaacttgtttatattatcatctttccagttatttgtcaacaactttttttatttactgataatatcaataaagttctgtattttctctgtcacttatcagcgacaactctgatactatatcacagctgccgccaagtgtcaacgttttttttatttttatttaaatatactgcattacttcttttaaatttgccacaccaattagttgtatcttaaactttcccttcaatccttctaaatttgctttcggcataatgcaagttgtaaatcccatcttttctgcttcttttactctctgctgcgcctgactgactccacgcacttctccggaaagtcctacttctccaaatatcaaagtttcctcatctataacacggtttttataacttgaaataatcgctgccacaattccaaggtcaattgccggttctcccagtttcattccaccagccagatttacataagcatcacactctcccaaagataatcctacccttttctccaacactgccatcaacaaattgacacggttgtaatcaattccaactgccgttcgtcttggaagcccaaaattggttcgcgttatcaatgcctgaatttcaattaaaattggtcttgttccctctaaagagcagacaacaacggaacctgacgcatctgtcggtctgccattcagcataacttgagatggatttttcacttccactaatccttgttcccgcatttcaaatacaccaatttcatttgttgaaccaaagcgattttttactcctcttaaaatccgataagaagcatgacggtctccttcaaaatacaataccgtatctaccatgtgctccagtactcttggtccggctacacttccatcttttgtcacatgtcctacaataaacatggaaatccccataccttttgcgattttcattaatacgcctgttgactccctgacctgtgatacacttcccggtgcagaagaaacctcttcattatacatggtctgaatggaatcaataatgactgcttccggcttttcgttctcaataattgcttttattgtctcaagattcgtctcacataaaagtttcatcttatctgtaaatgttccaattctctgcgcacgcatttttatctgacgcagagattcctctcccgaaacataaagcaaactgtgacctttatctgatagctgtttgcacacctgcagtaacaaggtagattttccgattccagggtctcctcctaccagaaccatagaaccttgaaccaatccacctcctagcacgcgatctaattcctcaatgtttgttgtaatacgattatcctctgtaatatcaatttctgagatggtagccggttttattctttctttttgtattccctgaccatttccagagattcctgaactctttggcagaaccgtttcttccacaaatgtattccattccttacagcctgggcactgtcctaaccatttggggctttcatatccacagttctgacaaaagaagactgttttttttgcttttgccatttttttctcctatattgtctctatattgcttgctatggaacaaaaacagccgaggaaaattcctcggcccgaatttgtatttcatgtgaatgactcggctgcaattaaccaagcttcttgcttaaactgcttattatttcttcttaatctcaactgctacctgttcagactgttctaattctacactgatggcaagttttccacccagatttgttttcataacgcctgcttccacgttatcaatcttgatagaatattctgcatcttcttctaattctactgtaatctgtgcatctttcggtccttctactttaaagctcatgccatctgcttctacattaagatttaaaacagtcgttcccggaacagattcatatacaaacatgccatttctttctaatttggtaatctcattatatgtttttactttatacatgtcaccatcatgttcaaaatcagataattttgattttgtatccaattcataatttccaaaactgattgtgccatcttcctctgtacgaattaattctttaattactgacataattatgtcctcccatatgtctttcgttagtaaacttttctttataaaccggatgcttccatttgtgttgtgtgaaccataatcagctattaagcctcacaccttttcagcttaaaccgtctttataaagttttgcttacatgaatattaccataaatcaaactttttttctagtttttctagtcatgttttaccataaattttattttttccttagaaacgccgattatcaccttatcgccctgtttaattcttccctccaaaatttcttctgccatcgcatcttcaattttattctggattgcccttctaagcggacgagcaccatatttcgggtcaaagccctcttttgcaatcagctctttgaccgaatcacgaactttcaattcaattcccatctggtctttacaacgcagggttaaatcttttaacagaattcctacgattttcttcacttcttctttatttaacgtatggaatacaataatttcatcaatacgatttaaaaattccggcttaaacatccgttttacttcttccattacgccctctttcatacggctgtaatctttcttctcatcttccaccgcaccaaatccaagacgttttggttcaataattgcctttgctccggcattagaagtcataataataatcgtttctttaaaatcaatctttctgccctgtgcatctgtaatatgtccatcatccaatacctgcagtaaaatattaaagacatccggatgcgctttttcaatttcatcaaataaaatcacactatatggatttcttctgactttctcacttaactgaccaccctcatcatatccaacgtatcccggcggtgaaccaatcattttagagacactgtgtttctccatatattccgacatatctacacgaatcatcgcatcttcgcttccaaacacagcttctgccaatgcttttgaaagttccgtctttccaacgcctgtcggcccaagcaggaggaaagaacctatcggacgcttcggatcttttaatcctacgcgacctctttttactgcttttgcaactgctgacactgcttcttcctgtccgactacacgcttatgcagaatctgttccagttttgccagacgtttcgattctccctctgccagttttttgaccggaatttttgtccactgtgcaaccacttctgcaacggaatcttctgttacgacaagatgttttctgctgcattgtttttcatatttctgttttgccttttccagttcttcttttaaagtatcctgctctctttgcagttcttttgccagttcaatgtctccacattttaaagcttcttcttttcctgaaatcagtttatgaatcgtttcctctttttccacaatgccttccggtactttataaccggcaagctgtacttttgatgacgcttcatcaatcaaatccagtgctttatccggtaaaaaacggtcattgatatagcggacactcatatctactgctgcttccaatgccttttcttctatttttacaccgtgatgttcttcataatatggacacaagccttttaaaatcgcaactgcttcttcacgacttggttcttccaccgtaattggttgaaatcttcgctctaatgctgcatctttttcaatgtacttacgatattcatccaaagttgtcgcaccaatcagctggatttcccctcttgaaagagacggctttaaaatatttgaagcatcaagtgctccttctgctccgcctgctccgataatggtatgaagttcatcaataaataaaaggatttccttatcattcatgacttcctgtaccacttttttaattcgttcttcaaattctccacgatatttacttcctgcaaccatgctggaaaggtctaatacaaccacccttttatccagcatcttttccggtaccattccccagacaattcgctgtgcaagtccttctgcaatcgcagtcttaccaactcccggttctccaaccagacacggattatttttagttctacggcttaaaacctgaataattctcgaaatctctttttctcttccgataacaggatctaattttccttcttctgccatctgagtcaaatcgcgactatactggtcaagggttggagttacactgcctgtctgtcccttcataaaactgccattttgaatttcttctttagaaatcatatcttcttttcccatagcttttactacattaagatataatttttgtatattgatgccaagtgtatgcagaagtcttgttcccacacagtcatactcttctaacattgccaaaagcagatgctccgttccaatcgtacgtgatttaaatttaccggctgcctctcgacttctaaaaagcacactctcaacacgtggcgtatatccttgcggattttctaaaatcacttcctctgtcggtgtaatcaatttatcaattaattccattaatttttcagaaacaaccccctcttcacaaaggatttccgacgctgttgttccggtcgccaacaaaagccctgcaagcaaatgttccgtccctatataattatgcttcttgctttcggcagtttctttcgcttttttcagcgccaacaatgcctgttttgaataattttctttcacgaaaagcctccttattatttcatgtcctgtttttactgtcctattcgtcaaccagatattcgcaatccactttactacctgctttattcatactcttcataaatttcatcaatcaaagcatgcacttcttcttttgaaatatttctacagcttcccttcgcaagcaatatagcaagtgtctctttcatctcctgtaacgctctcgctttatttacatcaacagcaatcactgcacctcgtctgcggtctatattgacaaatccctcctgccgtaaaacagtataggctttatttacggtatgcatattaattcctatcgtatctgccaattgccttacagaaggaagattttctccctcctgaagctgtgaggttgcaattcccataataatttgattacaaagctggacatagattgcctcatcgctgttaaaatcaatttctattaccatttttccacctgcttcctctttggaattgttatatatagaataatgtgaactgcccatcacctaaaagtaatggacttcaaaggagccgatgctcctatttaagaagtttgatatttaagtttccacctgaaaattcaggcaattctcattcttatgggcgtgtccacttcgcctctgttgtatagggtagtcatatccactacactacttttacacataatgtttagcgcattgcttacattattatatcatatcttttactgaaaagataatattttagttaaaaattaaatgcagtaccctttatccgttactgttcactccgttcacagtaacttggtcaaaatccattccacatcacctacggtgatgggattttgccctgtatatctcgggattttgccatattcatggcaaaacacctcgcgggatactacctgtgaacagtaacctttatcctacaatctattgagaaatacaaaaagcagattatgaaagcaaaaattcataatctgccctgttctttttttctgaatttatttcattccaagccttaaaatcattctttaagccagcatcattctgtcatttgcaaactctccaccgcttacttcttcaaatttcttaagcaggtctgctacctgaagctgttttttctcctcaccggaaacgtcataaatcactcttccttcatgcatcataatcagacgatttccgtgtaaaattgcatctttcatattatgtgttaccatcatagctgtcagattgtggtcactgatgattttatcagaaagcgctaatacctttgccgctgttttcgggtcaagcgccgctgtatgttcatctaaaagcagaagttttggtttcttaagggatgccatcaataaggtaatcgcctgtctctgtccaccggaaagtaatcctactttactactcaaacggtcttcgagtccaagatccaaagttttcaatgattctttaaatgattctctctcttttttcgtaattccccatccaagtccacgtctctgaccacgtcttgccgcaattgccatattttcttcaatcgacatggttgctgctgttcctgtcatcggatcctggaacactcttcctaaaaatgctgcccttttatgttccgataattttgtgatatctaccccgtcaatcacaatttttccggcatcaatactccagactcctgcgattgcatttaaggttgtcgattttccagctccatttccaccgataatcgtcacaaaatcccctggatttaaatttaaatttaccccatttaatgccactttttcattgattgttccggcattaaatgtcttatgcacgtcttgaatttctaacatgtatcccattatgcagtcctccgtttcttgaaatatttctctttcatataaggaactgccaggaagcaggcaactacaaccgcagaaaacagtttcatataatcagacggcatcttaagccacagtacaaatgcaattacaatataataaataatcgctccgaaaaagattgctgcaagagttaatgcaaatgcgattttctttcctgcacataattttccaaaaataacctcgctgataataactgctgcaagtccgattacgattgcacctcgtcccatattgacatccgctgcaccttgatactgtgcataaatcccgccacaaagtccaactaatccatttgaaatcattaatgccagaactttgttaaaggaagtattaattccctgcgcacttgccatctgtggattacatccggttgcacgaatcgaagatcccagttctgtaccaaaaaaccagtaaataattgcaattaatgcaaccgcaccaagaatcagttttaagaagaaaaaggcacttccttctccggttacataacgaagagaggcaactaatttatactgaagcacattaattgcctgattggattttcccataattccaagatttatcgaatacaatccaatctgtgttaaaatactggcaagaatccctgggattccaaatgccgtatgtaaaattccggtcacaaatcctgctgccattcctgcaagaaatgcaaaaacaagtgcaagtgccggattcataccgccacggattaacataaccgcaaccgccccaccggtcgccagtgaaccatccactgtcaaatcagcaaaatccaaaatacgaaatgtaatatatactccaagtgccataattccccagataattccctgtgccacatttccgggaagtgcacgcacaagtgtcattgggtccaaggctgcaaaataaactaccatttttttatccttattcctttatttttcttgtttcaacccacagtcggtaatttcacagagtctgacatgtcagcaaaactctgactgtgttttacctcatgtcagtggggggataccgatttctctccgcccaccactgccattaaccttcctgtttgcaattcctctcaccacctatagaggtgggagaatccttgctatatttgttaaacgatatactctcgaagcctttcctcctacagtatgcaaaaataaccagacaaatagcgcagactaaaaattcatcctgcgttatttgcctgaaaatcaaccttatactacactactgcacagaaaaattccaagagtaattcattctgttcttttattcctgctcaattgcttcatattcatccggaacttcgatgccaagttcttcacaaattgtcggattatacatctttgttacatttggtgcagtctcgatttccatagtacttatatcttttccgttttcaagaatatcataagccatttcaccagctttgtatccaatatcataatagctgatagaaagggttgcaataccacatccggcacagataccctgctctcctgcaactaccggaactttagccggcagacagatattattaataatttctgtatttgatgccattgtattatccgtcggaatgtaaagtgcatcacactcggaaattgcagaagttgtaacagactgaatctcattggaatctgctgctgtatattctttatactcaattccatcttcttttaacgcatcttcaaataattttgcctgataagcagagtttggctctgcagagcaatataaaattccaactgtttttacatccggaactaattcaaccaacatatcctcctgctggtcaatcggtgccaggtcactggtacctgaaatattcattccggttgaaccattccagtcagaaatatcaagtgcagttgcataatctgtaatagaagttcctaaaatcggaatggaatccgttgctgctgctgcacactgaagtgcggttgtcgcatttgcaagaatcaaatccacattatccgcaacaaagctattggtgatggttgcacagtttgcctgctcaccctgtccattctgaaggtcgaatgtaacattatcctttccgaatttttcttcacacgcatcttcaaatccctgtgttgcctggtcaagtgcttcgtgctctaactgctggcaaataccgattttgtatacttttccggaatcagaagaagcactgtctgaagaactatcggaagaacctgaagaagaacttcctccacatcctgcaagtgatgcagctacagatgctgccattaaaactgccataatttttcttaatttcataatcttttcctcctttttcctcaatggactcttcgctttaaaccgttaccctttaaagcgataaatcatatagaaattataattaagattatagccacttttgtacctttcgtcaactaaaaaaacagcctgaattcattaaattcagactgtttcttcccattttattttttcgacttactttttatgcttcatcaatggcttttccaatgtcatttctcatgtatttattctcaaaagaaatccattttgttgcctcataagcatttgcacgggcttcttttaaatccgcaccttttgcagttacacctaagacacgaccgccattggttacaatttttccgtccttaaatgcagttcctgcatgaaatacataatatccgtctttttccttaaacgtctccaacccttcaatcggaaatcctttctcataggaaaccggatatccatcagaggctaaaaccacgcacactgctgcattctcttcaaactgtaaatctattttatccaatgttccatcaatgcaggcttcaaatacttccacgatatcattttttaatcttggaatcactacctgcgcttccgggtcaccaaatcttgcattatactctaagactcttggtcctttctctgtcagcatcagaccaaagaaaataattcctttaaattcacgtccctctgctgccattgcatctaccgttgcctgataaacatatttctcacagaactcatccacttcttttgtgtagaatgggcttggagagaaagtacccatacctccggtatttaatccctgatcaccatcttttgcacgtttatggtcctgtgcggatgtcatggttttaattgtttttccatctacaaaagaaagcacagaaacttcacgtcccgtcataaattcttcgattaccagagtatttccggcagaaccgaatttcttatcgagcatgatggtttttaccccttcttctgcctcttccaaagtgttacagattaaaacgccctttccaagcgccaatccgtctgctttcaacacaatcgggaaatctgctttttctcttaagtaagcaagtgcctcatctgcactttcaaaattttcataagcagcggtcggaatattgtattttttcattaaatcttttgaaaaagcctttgaaccttccaaaattgctgcattttttctcggtccaaatacacgcagaccttctttttcaaaggcatctactactccaccaaccagtgggtcatccatacctactacggttaaatcaatttctttttctttcgcaaaagctacaagtttatcaaattccattgcgccgattgctacacattctgcatactctgcaattcccgcatttcccggtgcgcagtaaattttatctactttcggactctgtgccactttccacgcaattgcatgctctcttccgccgcttccaataattaatactttcatgtatgttcccctttcaccgctcttgttattcttttatttttacaagaccgtttactacttccactttaccatttgcaattaaatcaattgcctttggcataatcttccattctgcctcttccatgactcttctttgaagaacttcaggagtatcttcctgtttcacttccactgccttttgtaaaataatcgggccggtatctgttccctcatctacaaagtgaaccgttgctcctgtcactttcacacctctttttaagacaccttcatgtactttcaagccgcaatatccggttccgcaaaaagatggaatcagagccggatgaatattaataattttatttggataagcctttaccataatttcaggaatcacaaccagacaacctgcaagcaccaccaaatccacctgataagactgaattgtctcaagcaaagcctgattaaatgcttccctcgattcataactttttggtgaaacgcattttgcctcaatgtgatgtgctttcgctctctctaacgcataagcattcggattattactgattacaaccgcaatttccgcatttgtaattgttccactttcaatggaatcgataattgcctgaagattcgttccgcctcctgacacaagtaccgctaatttcacgtgcctcttcctcctgttattaatgtatctttggagttttttctccactaatttttgcaattgttctttgccaatcacatccaaattttatccatttttacagcaaaagggctgcggcatccaacatgccacacccccgctcattttatttatactaattttacgcctttttcaccggcttcgatttttccgattacataaggagtttctcctgctgctttgactgcttctacggtcttgtccacatccgcaggatctactgccataatcataccgatacccatattataagtattgtacatcatggtttcttctatctgacctttttcggccattaatttaaaaattggaggaattggataactgtctttttcaatcactgcacatacatcatcttttaacattctcggtacgttttcatagaaaccaccgcctgtgatatgactacatgcttttacacgcactcctgcttctttcacgcttctgagcgcttttacatagatttttgtcggtgcaattaatgcttctccaagtgtttttccaagttcatcataataagtatccaatgattcttttgtcatatcaaatactttacgaactaaagaaaatccattgctgtgaacacctgaagatgccatacccactaaaacatcccctgcttttaagtcttttcctgtaattaaatctttttcatctaccacgccaactgcaaaacctgcaaggtcatactcatcctccggatagaaacctggcatttctgctgtctctccaccgattaatgcagcacttgacatttcacatcctgttgcaacaccttttacgatttccgcaattttttccggatagttctttccacaggcaatatagtcaaggaaaaataaaggttctccacctgcacaggcaatgtcattgacacacattgcaacacagtcgattcctactgtgtcgtgtttatccataataaatgccagtttcagttttgttcctactccatctgtaccagataccagagtaggtttttccatgtctttaaatttttccatagaaaatgcacctgaaaagccaccgatatttgtcagtacttccgaacgcattgtctttttgatatgttctttcattaattccactgatttgtaacctgcctcgatatctacaccggcattcttgtaatccattttgttatcctccaattatttgttgtaatttttatatcctacttcctgaagctttgcatcttttgcaacgacctggtcttttaagtcctctttgtagtctttcagcttcttgagaagttcagggtctgaagttgccagaatcttggctgcaaggattcccgcatttgcgcctccattaattgctactgttgctactggtattcctgacggcatctgcacaattgaatataaagaatctcttcctcctaaagatgtcgtatgcattgggataccaataaccggcattggaaagattgccgcacacatacccggaagatgtgctgccataccagctcctgcaataatcactttgaatcctttttcctctgcacttttcgcatattcaaagaacacatccggttctctgtgtgcagaaataattgtcatttcatagtcaatcccgaatttttctaacatgtctgctgctttgctcataacaggcatatctgagtcgcttcccataacaattccaacttttgccatgattcaatctccttcttaaattaatatacaaaatgtctggtcttacacggacaattttacatagacttccaaaacttgtcaacaggtttcaacaggtttcgtcaagaacacggttcaattcttccgttccgacaagagaaaatcttccattttcaataatggaagcaatttctcttccctctttttctacacggataaactcaatttcttcataaggaatggtaatatccgtatgacatccaaaataagcctttcccgcatcctctttacgaagcagggaaatttcattgtcccttgcaataatctcttttccatccggattatacacagccgtatcctctgaccagctgtaacaggtatctcccaatgcaaaatgcggacccgttttctctgcaatcaaaattggaagtttggcttcgattccatattttcttcccatcctataagccgttgtgttcgttccgattgcaaattctccgatcggaagaaactcatgatgatataaaatattactttcgatataagctttattttcatctgcggtttcaaaattttcacaggaatattgcgttgtttttccatcttccagacagatttttaaatttttataatacaaaccggaaagataaactccgcttacatgaagcacaccatttgttccctccaacttcggactggtaaatacttcacccaccggaatgttgacatcggcaacacaattttcaaagttcgtttctttctctgaattttttaaggtatgaagcataattcttaaatctgtctcatttgctccctttcccttaatatgcaccgagtctcccttatccagaacatcaatcattgtctgctgaatgttttgatataaatgataatccagattatttaagcgcacggtctctttaaaaatttcacgaaaatctgctccgatttcacaaaccggataggcgataatcgtaaaactgcgttcttccccgataatataacgatttacaatctgtcctgcttcattgctgtaagtcacctttaacttctgctgatgcggatttaaactccacgcttctgctttcgtttccggttcaaatggttcttcaccaaatgtttcaatcactgccggaccagcatgcgtattggcaagttcctttacctgttcataagcgacctgcatcacccgcaattttctgcagacaaattcctgattaaaaaatagcgcattgtcttctttatggtcgtaatcatactgacggtttggaactgccccataatagccaattctattctgaccatttcgattaacagcatggactgcacttcgatagatagtcggacgaagtcccatcttggcaaactgtccaactgcagattttaccattctctcaaatccaagctgataacggatattgactgtttttttcttcgataaatcttttttacccactacaaatccgattcgatagccctcactaaaggttctcgccattttatcaatttcttcctgtgaaaactcacttaaaaatttcgccatctcttcttcattttgggtgacatattctccgaattgatataaataccgcacatcgcttaaatcactgttttcaataatcttcacagcaaaatccaaatcaggatctactgcttcacggattcttcttgaaaccatttcctcactgtaatcactgacataccagtacaatgattccctgacttcttctgccgacacaggcgattcttctaacaaattataaatctgtacaaacagttctaaaatcacagtcatatcaaacagacgattttcatagacaaatacaataagccctcttatctcagcctctaaaaagcaaatcagcggaccaaattcttttcctaacagcttctcggcataagcaggatttgcataagaagtctcatagtgttccggcagaatatcctggtacaaccgctcattatttttccttaattcttctaaagaagctgttttgagccagccatcctgaatttttccatgcagtctgattaagtattcaagaaaatcggctgttttcttaaaatatcctaaaaattgttccggcagtttctcctcgtcttttatctcaaaaattcggtccgtaaccaacgaaaaacgttcttctaaatattcttctctactcatcttttaaattcccgttttttacatttttttcaataatctgagtcaccacttccatcagcgtatccgaacccatctttgttcttttctgtctttcttctacctgagaacgtttaatctgacgctctctccaggattttcctcctgttttatcatttaacagaatcggctgtaaattgtccatacagcgggcaaactttgcttccggcgtctcgcaggtctcaaattcttcccataaatctctcatactctttgcctggtctttcggtaaaagactaaaaatccggtctgccgcctttacctcacgttccctctggcttaattttcctttttcatcataagcataagtatccccggcatcaatttccacaatgtcatgaatcaacaccataagcattgtcttttgtacatctattttctcttttgcatactcagacaaaagtgctgtcataagcgccagatgccaggaatgttctgcatcattttcttttcggattccatcagaaaggtacgtctgacgcccgataaatttacttttatctgcttctaaaataaattcaagctgttttttcaaccgttcttccataatttctacctcatccaattccaatcaaaaacatcgtaatccaaagtactgttaacagcccgtttgccactgcgcctactttgctgtacaatacattcctgttttcctctgaaaaactctttaagccaagaataaatccatatacagaaaatccgattgcaatgaatcctgctgctccgagatataatccgccttttccacccatcatcatcgagcagatagcagaacctacaaacaaaagaaacgacgcaaatgccaaaatagaggataactttccgcctttggtatgtttctttctggtaaacgcatatttatatctctttctcgccatatttcttcctcctggtctggtcatctatcaaatggcagacagcaaacaggatatacccgactgccgctcccagtgtattcaaaatcaaatcatctacatcaaaacatccaactttcgttatcagctgaactacttccacaaacaagctcaaggcaaatcctaataacgtaatcaagaaaaagcctctcgcccgacggacaattaaaggaagtataaatccaaagggaacgaatcctaccacatttcctaacagattcgtaacgactgcaaatactccaagttgttctctgtaaatccaaaatcgttttatttcccgaaacggaaccacattataatggtattcacgctctgcgaaccctgctcttccatatgattccgaaaaaaacaggaaataaatcagtgcagcaatataaagcagaaaagcaaccattcccgctttctttattttattttttatttccctgttcaatttatacgctcctgtactgaaataaagagggcattttcttaaatatgccctctctttctgacacaaggcatactcctgataagcctgtcatgccttaaattgtcagttcatatttcttttttattaatcttgctccattaataatcagcatagtgccacttacaattccggtcactaataccacaattccaattgccagtgtaccaccgcctatgcctgccattgttttatatactttttcattcataaaatcctgcatcctcttgattcatttcatacaactgactttttcatttttcaatctattttacgccatattcctcatagtatgcgtcaattgcggattttaatgtatcatcaattacaacttttccattacattctttgttgtaaagacattccactacttcttccattgttacgattgcagcagtatcaaatccataaaggtctttgacttcatcaagggcgcatttttctccaccctttccgatttccatacggtttaaagaaaccatcagaccaacgatagtcacatctgctgcccctcttaccttcggtacggtttcttccatagattttccggatgtcgtaacatcctcaatcataatcacacggtcaccatcttttaactggcttccaaggaattttcctttgtctgcaccgtggtctttttcttcttttctatcagaacagtaacgcacttcttttccatataattcactgtatgcaattgcggttacaactccaagcggaattcccttgtatgccggtccaaataatacgtcaaagtcatctccatacgtatcatgaatggcttttgcataatattcacctaacttttttaactgtgaaccggttacataagcacctgcattcataaaaaacggagattttcttccactctttaaagtaaactctccaaatttcagtacatcactttctaccataaattcaataaactctttcttgtatgcttccatttttaccaaagcctccattattcttctattttatgagcagtctgctcttttcttctaactgtatcattgatattttagcacactattttctacttgacaattcttttcacttctttaccaaacaaaaaggccaatgaaagccttgccttcattgaccctttcgcatttcatttcgagtattgattcaaaattttatttttcttcttttttctctactcctgtgtcttttcttctctttttgtaatagagaatcactcctgcaaatacaccagaagcactaatcagtcctgccattggaagaaggaaatcggtttcatctcctgtcttggcactctttgcactgctgctgcctgttgtctggctgctgcttgtctgtgcctgagttcctgttgtcttattcgtgcttccactttgcgttcctttgttggttgctgtaccggttgtggtatttgagcctttgtttgttgtaccggttgttgtaccagaacccttgttgttattcttatcggtcgttgatgtgttattatctttgttgttatccttgttgtcatctttcttatcatctttgttgcccgggtccggtttatcggtattatttgccagctcttctaagcgtttgatttctgcttctcgctcctcaagtgccgtttttgcatctttaatcattgctttctggctctcacttaaagcatcatacgcttttcttgcctgttccactgcggtcttgtctgccagtttcaaatcttttacttctgggagactgttaatctgctgtgccactttttctgcttcttctttttctctctcgagtaagctgatctggttttcagcggttaacagcatatccactactccactttctgtcaactgacgtttctggtctgcatttaatgcatcataagcatttcttgccaaagatactttttctgcatcctccagtttcaaatctccaactgccggaagttcctgaatctgttttgttacggcttcggcttcttcttttaatgcttttagtttctgctctgccttttccagtttgtcatacgcttcaccggaaacaaacttcttctggtcatcactcagagcatcgtaagcctctcttgcctgtttcagtaccgcttcatcctggaacatcacatcctcttcggacggaagggcattgagtttttctgtcactgcatcggctgccgctttgtctgccgcatcctttttcagtttttctaactgcgttcttaattcaccaagttttgcaacactttccggtgcttttccattcagatattctttctgagcatcacttaatgcattgtagtgtgcctctgcacctgcaagagccacttcatcatccagcgtcagattgtctttggacggaagcgcattcatctcttctaataccaaatccgctgcctgctcttcgagtaactgtgcaatcttcttctctgcactttccagtttgtcggttgtttccttggaaaccagtttcttctggtcatccgtcagcttgctgtacgcatctcttgcagcgtcaactgcttcctgatgttccagagtcacattttcggctgtcggaagcgcatcaatctgagcaatcacagcgtccgctgcttctttgtctgccttttctttcttaagagctgccagttgttcctctgcttttaagagcacatcgtaattacttacatatctcttctcctcacgggtcagggaatcataagccttacgtgctgtggtaatctttgcttcacactcatctgtaagctcaatggtttcatcaatctgcttgatctgattttcgactttttcaccacgttctcttgcaccaggtgtttcatccaacgcttctaaccatttattccaggtagatgcattgccacttgatgcaaatccggactcgtctttcatatcagactgttctactttgtagtcatcgatgtaatgccatacgatttcatcacctgtggttacataccattcatttaagcctctgtccgggtgtactccgtttacggtatacatccagccggaatttttaccgttgtccatttcctttaattcataaccaccataaatctccggtgcggtaatggaactaatgtagttgttttcaattcctacataagaaagtcccgcttcctctaatgcagtcttaaacacttcaccaaccgttacttctgactggtcaaaactataagtaccggttgcaatccatgtcgtataagcatgaacggcttcgttgtcacttccctcttctccgtgtttggtatcaccaatcagacggaatgtaacaactgtcttgttcgggtctgcggatgggtcacttactttatttacagtaatggaactcatcactgcagtcaagagattgtgaccagcttcatctttcttgacagccgtaaaacgatgcgttcctaaagaaagggtattggtttctacctgaagctgtccattttcatcagttgttccaatcagtttacttccttcataaatctctgcatcggcaatggcttctgcctttgcatcattttcagaaacacctgctcctgctaatgtcaaggtcagggtttctccacgattgacactctttgtttccggtgtcagatgtgcatctttcatgccatcccatccagaactatagaagaattcaaccttatctccatcagatgctaatgtattggccggatcatcacataccacaccatttaccttgcagatccagctggctttctttccgttactttctgcaatggaatcaccggtaagtacaaacttacctctgtaacattcaaaacctgctctgcttgcatcggctgcatctaacaatgcatgaagtaccgtgtaaccgccatggttatataagacataacgatttgcagccaaatcttttgcttcctgtgaaatggctacatccgttgtcgggcagaataccgtactctgtccggcaagctgtaccgataccgttccagactgagccggaactgcctctaagctttctatacggataaccggattggtttcttcatctgttactttgaaactgtctgtcttggtcaggaatccactcttagatacatagtaagtataggttccattttcaagcgtgtacgttccatcctcattggctttcatcgtcttgctgccctgcattacaagtacggatgcaccttctggaacttcgaaggttgtctgttttgaagcggaacgacgagttacgtcgatggtgtaggtactgtctactcccattcctttagctgccttacatgtcactgtcaatttgttgacaccaacttccagtggaattgcctctcccgcttcataagtttcttccgttccatttatagaaacagtgtaactctccattgtatcttttctgttccaggtatctccttttacatttaccagaatcttatctgttccatttggaacagatgtactgaaatgttcttctgttccaataaatccatatcctaaatcctgtgtaatcgtgttcttttcagaatcttcatacgtaacatcgtctgcttccagaattccatcccaacgtcccagtgcttcacttccttcagctgctgaaattgttatatcttttggaagaaacgccatcgtttttttgtttttagttttatataaatgtgttgcataagtcatcggacttccattactcggtactacaatgacttcgacctgcatttgtcgcagtgatgcctgatcaatatcagctcctgtatacaacaatggatttccaactatataattgttttcttttccataagaattttcttctttataagacttggaaaagctcatttcctgtacaacagccttacttttatcagaacccagccaatatctaaccaacagttttgcgtctttatcttcttgcagtaaatctgctcctacttggacttttaaatcttgttcactcttaaataatcctaatccacgattgacattctgtgaaatatcactatgcgctgttgcaaataaagccgtaccgctgccctcaataattgaatccccatctggtcccaaagctacagctaatgcttttaacattcctgccgaacgactcacagtttcttcattctcatcatttgagccgacctcaaatgaaatttctggaatatatgccatctttccataatcaatattcgggttatctcccccattccaataagttcccatggaatttcttgttaatttacgatgtgcaccatccgttgttccccaggcacttgtacttaatgcaccatctgtaatttgataagttccagcatcttcatcctgcagtctcactataaaactactacctgccatatactgtccaaatgaagctgtatagtccgttccatttgttttacaagtaaactgcacaccacttggattatagattgccgacattttaaacattggaggaatcatattttccattgttatctttgcagtatctccaacttccaagctttttcctggtttatacacattatcaattgtaacatccaatcctctagcaagaatcacatgatagctagtcgcatctcctgcttttatctctatgatatttcgtccttcagataactgaattgtataactctgttttccatcttctgttgtttttgcctgataggttttccatgaactgtcttttaaccaatctgtcggattttcactgagttttccatccgttacagtaatcggtttatgaacacgcacggatttaatcttttctgaactatctcctgttgttgctgtaggaataaacgtatattctgcagaatcacttatctcctgcgtaactccatctgctcctgtctgacttttaagataataaacggtacgtccttctatcatatcgatattagaagttatctgtgtctgtgttttctcttctcccacatgcacaactgcaattccagtcaattccggcagtaatgcactataaatataacttcctgtaccacttgcaatagaagcagtctccactgcatcataataaaaagcaaccagaaccgtaccctcaccatttgcatgaattcgaccaaactgtccaattttatcatcttctgttacttcaacagacgcaacactttcatctccaccaattaccacataatgccagtctgggtcattatgtgcatttgccacaccattttctactgcctgccatgcacgtaatggtactaaatcaaaatattcacctacattcaaatcaatctcactgttttctggaagatttgtcagcatactggcatagattccatctttttcttgctccctgtgtatctgcgttggattatcttcaagcggagcaaccgttacctcggtatggtcatcgttccattccccattcagattcttggtataacgagttacttttccttcctgacgcatcatataggtaaagccttcgggaatcttgtaataattatatccgtcctccgtcttaaaaggcgtataggatttccagtttctggccgtatagaattttaattcccaagtggtgtaaacttccatgtctatcggagcttttaccgtgatataactctttttcaaatatggaatttttccattatctgaaagatttaatgaaccaaaatccgtttctctgtaaacataaaaatgcccttcaattggcagatagttttcatcaaaagatgtaaatttaaaattataataactgtcgccaccacaattcggaacaacataattatacacatcatctgtggcgtgccaatattctttctgctgcttttcatcataaagacttagtgtaccaagttcgggaagatatacccgttgatgtttttcattaagccaagctgttggagaaacattcttaaaataaacacttgcaagctttaattccgttgtatcttcagtcactgtaaaatatccacccgcaccgttcaatgaatcctctccatcacccgcatattcatagcagtattctcctggatttacggtaaaacttttatcttttacctcaatttcttgttttttatcagcagtatatatttttacgttactgatgccagtaagattaattaccctatcggtattttctgctgcataaacatttactctcaatattcccaacaaacacattgtaagcagtagatagcggagtatttttttcatttttttgttttctttcgtctctttcatttttcatcctttccatttttatttaatcttatattaactttttatttcacttcctcccttttctttttctccctcttattaagtcatcacagcgtggggagtattttattttccactgtgcgactgtaaggtttcattgtcacgactttttcactttccttccttttgctgtctgtcatgacaataaaaaaagcccgtacaaccgaaaggtcatacgaactgatttctcatcctcgaactacagatattccacatctatttaatcagataataaagggtactgtttattcttatgcttcagtcaattcgttcctggcctccgaattttcttaaatgttaaagatgcttttttacgctccgtcttctggctcaggaccaattaacctactcgatgtgtcttaccaaatctgattcattcagtgactttttccatctttcgttgtccttacagcagggaaaggatctgctccggattctaaccggattccgttctaagtatcatcaatacttataagcgtacacattttccaacatttctgtatgaaattctatcaatcctgtcataatactaataggattgttgcacggtaatcttagattctttccatccaagatgcctttacatgatttataataactgtaattcatagttttgtcaatgttttctgacattttccttaaatccttaggctattcgcaaagttttttatgcacttttaacaatttcttgatattctcacttctaatcaccgtcagaaagcttgtcaatttttcacaactaaggaggtttcctatgagaacaggtcaaaacatctataaacgaaaagatggacgttgggaagcacgagtctttcttggaaaaaagtctaatgaccgtccacatttcaagtatctgtatgcatcgacttacagaaaagttcttttttcgaaaaacaatcatgaaaaaatgcttactttgtcaaatgaaacaacgatttctactgctttattttcggattcggcttataaatggttagcagattcttccaggcgttggaagccagcgacctatatcaagtataaaaattttctggagaagtatattcttcctgaatggaacacgctctatgtacgtgaaattcaacaggatacttataataacttctaattcttcctaattgacgtgttgatgcaagaactatcttgtaaaggtttccctcttcattattagccaaatctgaatatattttttcttcaatgctatatatcggatacccctgttctatcaaaccttgtacataattagctcttcctggagcatcatttatttccattaatacccactgtggaattaaaatcaaatcatagacttttagcacagactctgaccgcactccttttatttgcaatgtctgcataaatgaaattgaagaagtatccagaagcgcaatatgttttttattatcaatttttgtaatcttaactatctcgatcattcgcctctcctcgtcagtatagaaatttctgtcataatattcttcaaatacttttcattatccttatgataattcagttctggatttgcaacttttattttctttattctttcctgtaaggaagatgtattgataacataagaaggcattactaagctatcatctaatcctaacattctaaatttatttggtaaatcctcaaattgaagatcgaataccgctttaattctactacaaagtttttcattttcactttgaacagcatactcatataatgataccagcacagctttatatggtgcttggaatgttgacatgcaataaaaaacctttgaagtaaaatccatttctggaagttctgtaaaatatttatccacaccgttcaacaacatgcatccagcaaaatattccgcttttctttcttccaatgtgttatccacttcaataaaatggtcaaatgatactttgtcaaatattaaatgatatatctcatgccatgcagtaaagtattgatttgcccttggaagagaagtatttatcacaggaataacttttctatctttaacaaagattgctccgctccagaatttatcttctataggcatttgaatcaatccaaatccctgcaggattagaagtgcaagttgaggagctgatgctactttcataatcgctggatttgtctgaagtataatagtttgtgttagtatttctttcttaatttcacgattcttttttataacaaggtccagattctgaacagtaattaattcactcatagtgtctacaactccattttatttcaaacaaagctaccactttcaaaactatgtgcccttaataataaattgcacataaatcgataacatcaagaagtaactcatactgtttcttcgctgtgtcgctcattttatgattcattggtgcattttgtgaatacactgtcattgtatcattctttgttggcatcgaatgatacagcatcaactcttccactgtcatattatcttcatctttcattttaaaattcaagtgtcaaattccgaaagacaaaaaacaccgtcacctttggtaaaaaaaacaaaccccccatacctttggaaatcccaaaagtacgggggtatcagttggagtatttaattcaagattttatttttcttcttttttctctactcctgtgtctttttttctctttttataatagagaatcactccggcaaatgcacctgaagcactaatcagtcctgccattggaagaaggaaatcggtttcatctcctgtcttggcactcttcacactgctgtctgttccttgttttccatttgtctgtgcctgacttcctgttgtagttccggttgtcttattggtgcttccgctctgagtacctttattggttgtcgtacctgttgttttgttagaacctttgttggttgtaccggttgttgttccagagcccttattattgttcttatccgttgttgatgtatttttgtctttgttgttatccttgttgtcatctttcttatcatcatctttattgtctgggtctggtttatcggtattatctgccagttcctgtaagcgtttgatttctgcttctctttcctcaagcgccttctttgcatcttcaatcattgctttctggttgtcacttaaggcatcgtaagcttttcttgccgcttctactgctgtcttgtctgccagtttcaaatcttttacttccggaagactgttaatctgctgtgccactttttctgcttcttctttttctctctcaagtaaactaatctggttttcagcagttaacagcgtatccactactccactttctgtcaactgacgtttctggtctgcatttaatgcatcataagcacttcttgccaaagataccttttctgcatcttccagtttcaaatctccaactgccggaagttcctgaatctgttttattaccgcttcggcttctgcttttaatgcttcgagtttcttttctgccttttccagtttgtcatacgcttcaccggaaacaaacttcttctggtcatcactcagagcatcgtaagcctctcttgcctgtttcagtaccgcttcatcctggaacatcacatcctcttcggacggaagggcattgagtttttctgtcactgcatcggctgccgctttgtctgccgcatcctttttcagtttttctaactgcgttcttaattcaccaagttttgcaacactttccggtgcttttccattcagatattctttctgagcatcacttaatgcattgtagtgtgcctctgcacctgcaagagccacttcatcatccagcgtcagattgtctttggacggaagcgcattcatctcttctaataccaaatccgctgcctgctcttcgagtaactgtgcaatcttcttctctgcactttccagtttgtcggttgtttccttggaaaccagtttcttctggtcatccgtcagcttgctgtacgcatctcttgcagcgtcaactgcttcctgatgttccagagtcacattttcggctgtcggaagcgcatcaatctgagcaatcacagcgtccgctgcttctttgtctgccttttctttcttaagagctgccagttgttcctctgcttttaagagcacatcgtaattacttacatatctcttctcctcacgggtcagggaatcataagccttacgtgctgtggtaatctttgcttcacactcgtctgtaagctcaatggtttcatcaatctgcttgatctgattttcgaccttttcaccacgttctcttgcaccaggtgtttcatccaaagcttctaaccatttattccaggtagatgcattgccacttgatgcaaatccggactcgtctttcatatcagactgttctactttgtagtcatcgatgtaatgccatacgatttcatcacctgtggttacataccattcatttaagcctttgtccgggtgtactccgtttacggtatacatccagccggaatttttaccgttgtctttttctttcagttcaaaaccaccacattcttgaggtgctgtaattgcactgatataattattttcgattccttcataagaaagtcctgctcggtcaagcgcctctttaaatacctctccaactgttacttcatctgcttcaaaagtataagtatctgttgcaagccacgtcgtatatttatggtcttttgtatccgttccatgctgggtatctccaattaatcggaaacttacaactgtcttacctggttcagcagatgaatcctgtgcttttttaatagtaagcgtactcataactgcagtaagtacattctgacctttttcatcttctagtgttgcagttaaataatgagttccaagagtcatgctgtttgtattcactacaaactgtccagactcattcgttgttcccaaacacttactaccttcataaatttttgcgccagcaattgcactgtaatttacatttttagcagacatttcttttccacttaatgttaaagtaacttctgtgcctcgctctacttctttctgttccggtgtcaaccatgcataggtcattccttccaaatcagaattataataaaactcaaccttatcaccattatttactaatgtatttgctgggtctttacatacaataccattaatttcacaaatccatccggcatttgttcccttagaatctgcatcttgttcatcatcaacagtaagttttcctctataacaataatatccaacttctttactgtcacacgctgtcagtaatgcatgtaatgctgtatatcctccgtggttgtactgcacatagcgttttgctgtcaaatccggtacttcttttggtatctcaacatcaagtgttggacacaataccgttttttgtcctgcaattcttacagatactgttccgctctgttctggcaacgcttcaagttcacctacagaaatcttaaggtctgattcttcatctgttacagaaaaactggctttctttgttacatatccactttttgatacataatattcgtagtcaccattttccaatgtgtaagttccatcttcattagtttgcataatcttattattctgcattacacgaacggaagctccttctggaatttcaaaacttacctttttagcagcactgcgacgagtgatatcaattgtataagtatactctggccatacgttaccgaacccattggcacgcctagccgcataagaaacttttaatgtgttatctcctacttttaatggaatatcctcatcattactatatactgtttcatcatcattaaccgttatagagatatcattcgtatatatagtattaattgctgtagcagaaagtttaattttatctgcttcataaggaacagaagactgaaaatgcgtctctgtaccgataaatccttgtcctaaactctgtgtaatttcggtattgttttcatctgtataggtaaaatcttctgtctctaagattccatcaaatcgtccaaatattcctttttctgaacctgaacttatttgcaaatctcctaatggaattgcaatttcatacttctttaaatttgtttgagcatacgtcatcactgaatatgtcattgggtaaccatctgacggaataactataacctctatgtttaataatcctggctctttcacggatgacgctggcactaatgaaaaacttgttatctgctgctgtccagtattattaggctttgtccagcttatttcaccccagtccaactcttttacttcaaatttagaactgtcatctccataccaatatttaacaagcagtctgctggtttccttattaaacataggttctgctcctacattaatagtaccttttgtactcttaattgccgtactatcaattaacgtcatttgatttcttggaactactgttttacttgtataaaattttgcatccaatacacttggttctgttggacgagtagtcccaccaacttttaatcctctcaacaatcctgcatctctttttgttacttcttccaattcatcattattttcaacttgaaaattgaatcctggaagataagagagttttccataatcaatattgggattatctcctccactccagtaacctgccattgaatttcgatttaacttcttatgtgcattccaatttgctccccagcctgctgttgaaagatatccatccgaaatctcaaatgttccctcatcttcctctgttagacggatattaaaccttgtacttttagaactcatatattgacccaaaccaagttcagattctacaccattagcattataatgataaaccacaccacttggattatagatcgcacccatcttaaaaacaggtggaataagacgagacaatgaaatttgcgctgtatctcctaccgctagtttctgccctggattatacatattattaatttgtacgtccattcctcttgccaagataacatgataagcaactgcatctccagcctttatctctacgatattacgtccttctgccagacttattgtataacttccatctgtattagccttataggttttccaacttttatctgttaaccagttttgaggatttttttgtatttgtccatcttctaccataattggagtatgcactcttacagatgaaattgttgttgtattttctcctgttgttgcctctggcgtaaacgtatattccgctgtatcattcattcttactgttacgccttcttctgaagtctggtctcgtaaatagtaaactgtttttccttctgttgcatctatattcgtggtaatctgtgtttctggattacttgcaccgtcctctgttacatttatgactgcaacacctgtcagttctggccaaagagcactccataaatataaatcagagccattactatcaagatcatttggtgcttccattgcatcataccagaaaacaaccagtgctttacctgctccatttgcatgtattcgtccaaactgacctgtcttgtcatcttctgtaatttctactgaggcaaccgcatcacttccaccaacaactgcataatgccattctgggtcactatgctcatttgatgccccattggatattgcctgccatgctcgcagaggagtaatatcaaagtattctcctacttttaaatctacttcactactctctggaagattattcaacatactagcataatatgtattttcagcactaactatctggtttggattgtcctcgagttctgaaactgtatatatggttttatcttcgttccattctcccttccaaccaagtcttgtaacttttccttcctgacgcatcactacattcataccatcaggaattttataatagttatagttttcgtctgactgaaacggttcataagttgtccagttctttgctgtataaaatttaacttcccaataagttaatatttccatatcttttggtgctttaacggttcgataactttttttgatatattttattcttccactatccgacaaattcaaagaaccaaatctagtatctccatatacataaaagtgtccctctatcgtttgatagtcatcatcaaaaggagtaaatatatacctataataggtatctccattctgttgtggcatcaaataagtatacacatcttctgtttcatgctgaaattcatgttttccatctttatcatatactgttaacgtacctaactctggtaaatatacatttttcgtacctacaaacgtagttggcgatatatttttaaaattaactgtaaccagttttaattctgtcgtttcctgcgtaacatcaaattctccacctgcacctgcagaatctttatatttatatgtacctggtacaacagatatcaaattcttttctgaatcaattgctatttcttctttttcatcttctgaataaattttaacttcactactttttcctgtaagttgaacatctactttattctcatccgcatgtacgttaaggggcaaaataaataataacagaaaactaattgtactccattgtagtaaattaaaaagacttctttttctctccataaattatttccttatattcaagatagccagaggttataaacctctagctatctttgtcttttctactatattatttttatattcgcttattttgctgataatacttcatcaaaataattatttgcttcatcttctgttccaaatgcccaaactactgtatcattatcatctactggaagtacagatgcacttacaatatcactaccttctacgatattggctttagaaccttctccatcaatcacacaataataccatccataatattctgtataatcttcactagagtaaccacttaatttattaccgtctgtgtcagaaatctctgatacatagcctccgtactgtgtaaaagaaatctctccttctttcatcaaactatataacgcatcgcctgctgttggataagtctgtgcagctccttcagaattactaaaaggatttccactatttccttttgctttcgccactgtcaggtcttctccgtcaaccttcatacccgtatcattatggcagtcttttacttttactgtaactcctgttgcatccgcaacgtcctctgctgattctacatacacagtcatatcgataccagcacttgtattattggtatttacgatgtgtaagcttgctggaccatattgaccagctgcaccagtaattgttactgtaccagcccaaccatctgctgtctccttagcaccatacgcataattttcaataattttaccttttccagcattaatactatcaactttcagtccgctttttgccgcatcttctgaatcaaaaccagttctctgataataagcgtttgctggcattaatccaagtgttacgctagaattagcttcgattggtgtagaatacagagtatccggtgttactaccaaatttgggtcaccatttgccgccaataccggcatagccatagacagtgttgtcactcctgctaataatactgaaactactttttttgtttgcatggttttatacctccattttttctccctcttattaagtcatcacagcgtggggagtattttattttccactgtgcgactgtaaggtttcattatcacgactttttcactttccttccttttgctgtctgtcatgacaataaaaaaagcccgtacaaccgaaaggtcatacgaactgatttctcatcctcgaactacagatattcacatctatttaatcagataataaaggggtctgtttattcttatgcttcagtcaattcgttcctggcctccgaattttcttaaatatcgggaatgttttattacgctccgtcttctggctcaggaccaattaacctactcgatgtgtcttaccaaatctgattcattcagtgaccttttacatctttcgttgtccttacagcagggaaaggatctgctccggattctaaccggattccgttctaagtattctcaatacttataagcgtacacattttccaacatttctgtatgaaattctatcaatcctgtcataatactaataggattattgcacggtaatcttagattctttctatctaagatgcctttacatgtcttataataactgtaattcatgtttttgtcaatgctttctgacatttttcttaaattcttaagtcatttgcaaagttttcttatgcacttttaacgatatcttaacattctcacttctaatcaccgtcagaaagcttgtcaaattttcacaactaaggaggtttcctatgagaacaggtcaaaacatctataaacgaaaagatggacgttgggaagcacgagtctttcttggaaaaaagtctaatggccgtccacatttcaagtatctgtatgcatcgacttacagaaaagttctttttctaaaaaacaattatgaaaaaatgcttactttgtcaaatgaaacaacgatttctactgctttattttcggattctgcttacaaatggttagcagattcttccaggcgttggaagccagcgacctatatcaagtataaaaattttctggagaagtatattcttcctgaatggaacacgctttatgtacgtgaaattcatcaggatacttatgataaactggtggaacatctggctcaaagtctttctggaagttctctgcataccatcaatacgattattaatggaagcttgaagcatacaaaaaatagtctgccgattttatgtaaaaatccgatttctaatcaggagaagcatcctctcgatgttctttctgacagtgagtcttatgattttctcttatatctaaaatctaaggattccttaaccactgttggaattcagcttgcattgttcagtgggattcgtcttggtgagctgtgtgctcttacttgggaggacattgatttgaaagaacaggtacttcatatccgtcacactcttcagcgaattcaaaacaaagaacaatatttcggagaacctaagacggtattatatctcggttcacccaaaaacaagcgggaacggactgttcctctgcatcctcagatgcttccaattttggaacggattgagagaaattaccagtcatcagattatcttttatctggaaattcgtcccccatagagcctcggacaatgaccagccgttttaaaaaggttttaaaaagttgtggcatccgggattttcattttcatacactgcgtcacacgttcgcaactcgctgtgtggaatcggggatgcagattaaggctttaagtgagatgcttggacattcttctgtcaaaatcacaatggaccgctatgttcatctgtccatgagtttcaagcaaagccaaatcactatcctgcggtttccggattcggaaattataaatcgtcaggaaactagtcaaaattatccgaaacgacaggaaaatatggtagaaacaggggtaacttcttggatagaaagaatctaagatgtctctttttattaatatatgcaacaggtcgaattttagaaccaaaaaatactatttttgtctttttttaggagaaaacaaaaatgacggagctttctggcttgtaaccacaaaactccgtcatttttgattctctttacactgcgttataaattagtggcgaaaacccacaggcaagcctatgggttttcgccactaatttataactatttaatacctctttcttttttcatttgctcaaacatatcatcccattctgattcttctctccattcatcatcagacgaaattacagctttaccattgttattataatttgtgttctgcattgccaacttatatgctttaagtccatatactccagtattcatattaggttgaaacggtaatgcctgttccctcacagcttgttttgcagccattgtaaaaaaagtagtaagatctaatccaaggttagacataagctcttgtaactgtactttcaaggtttcatccattctcattgttacatttgtatttgccatattcatccttcctctctcttctttgatattattataccatttagtatgtacatagttaatacattgttataacatttaattcatacattccaatatttcgcctgttcactcttccgtaccacacgcccaattttctgcaaatgtgagtcaaaaaatcccatcacttttgtttctcccttagatgcaagaaaaacaaagaggccgacaaaagctttcgctttcatcgacctcttcgcattttatcttacttcactttatttttttttaatatccttcattatggagcagttcatgtgtctttccattcaagaactctgcatacaatttctccatatccgcattatcatcggatactttaatcgcagattcggtatctacttcatacagtccttcggttcttacagattttacacattctcctgcttttacaggctgtccgccacccataacgcatccgcctttacaagccatcacttcaattaaatgataatttgcttctcctgctttcatacgacggaatacttcgtgtgcatttgcaagtccacttacaacacagatattgatatctgttccttcatattgaatcgtaaattctttgattgcttcttctccacgcataccaaactcggaaattgcttttaaggtttcggtatcgtgtgccggtacaaggtgacgaagcaccgcttctgttacaccaccggtaacaccaaagattttaccaccgccggaagccattccaaacggaatatccggttcttcgcattccatatttgcaaagtcgattccagcgctcttgatcatacgaacgagttcggttgtagtcagcacatgatccgtatcctgttctccttttgtaaagctgttcggacgtttgatctccatcttctttgcggtacaaggcatgaaagataccatcacagtacgtttgccttctgctctttccggatcacggtaccattcttttgcaactgcggataacattccctgtggggaacggcaggtagaaatattgtctttataatccggatactggtctaccacaaattttacccatgccggacaacaggatgtcataagtggaagttttccaccgtttttcacacggtttaagaactctgcggattcttccataaccgttaagtcagcagaaaatccggtatcgtaaacttcgtcaaatcccatctggtgaagtgcacttaccactttacccatggaactctttccttttggaagtccaaatgcgtctcctgctgccacacgcactgccggtgcaatctgtgcaatcactctggtatccgggtcttcgagtgcatcccatactgcatcgatatcggaacggatggtaattgcgcctgtcggacagactactctacactgtccacagcctacgcacattgtttctcccagacctttgttaaatgccggcataaccgttgcttctgttccacggaatgcgattccaagtgcttccacaccctgaagttcacggcaggcacgtacgcagtttccacataatacgcacttgttcgggtcacggataatggagtaagaactgcagtctaacggctgttcttcttttgtattttcatagcgtacttcttttacgccaaggcggtaagccaaatcctgaaggacacagtttccgctcttgtcacataatgtacagtctctgcagtgtgctccgagcagaagctctacaatcatttttctatatttttttaatctcttggtattagtataaattaccataccatctctcggtatttctgaacaggaggcaaataatttacctctctcatcttctactgtacacaaacggcaggctccataaatggaaagctccggctgatagcataaagtaggaacattgattccagcttttcgaatgacagaaaggacatttttctcgtcggtaaattcaacctttctgccgtcgattgtcataattcccataaatctcgtccctcctatctgatttcaattgcgtcgaagctacagttatctttacagcttccgcacttgatacattttgcattgtcgattacatgtggtgctttcttttctcctgaaattgcagataccggacaatttcttgcacacttggtacagcctttacatttatccggattaatatagtagttctgcattgccttacaggtatgggaaacacatttcttatctacgatatgttctacatattcatcacggaacatacgaatggtactaagtaccggaagtggagcactctttccaagaccgcagagagacatactttttaccatctctgcaagttcttcgaggcgctctaagtcttccatttccccttttcctgctacaatcttttcaaggatttccaacattctctttgtaccttcacgacaaggtgtacatttaccacaggattcacgctgtgtaaaactcataaagaaacgggctacttctaccatacaggtatcgacgttcataacaaccagaccaccggaacctacgatagcaccgaattttttaacggagtcaaagtcaagtggttcatctaagtgtttctcagtcagacatccaccggatggtccaccaatctgtacggctttaaattcagaaccattctttaatccgccaccgatatcataaatgatttcacgaagggtggttcccatcggtacttcaatcagtcctgtattttcgattgaaccggttaaagagaaggtctttgttccaggacttccctctgtaccgatcgtgcggaaccattcatgtccctctaagataatcttcggtacgtttgcatatgtttctacattatttaatacggttggttttgcccacagacctttatctacggttcttggtggtttggttcttggcataccacgatttccttcgatggaagcggtcagcgcactaccttcaccacaaacgaatgcaccggctccacgattgatgtgcatgtggaagcagaaatcggttcctaaaatatgttcgcccagaagatttttctcttccataacatcgattgcatgatgcagtcttgctacagagttcggatattcggcacgtacataaatatatccatcgcttgaaccaactgcataagccgcaatcatcataccttcgattaacttaaacgggtcaccttccattacggaaccgtccataaatgctccagggtcaccctcgtcaccattacatacgacatagcgttcttttactttctgatttgcgacctgtttccattttttaccggcagggaaaccaccgcctccacgacctctaagaccggataaatcgacttcttctacaacctgttccggcgtcatttcaaacaatgctttttcgagagcgctgaaaccgccggctgccatatattcatctaaagattctgcatcaaattttccacagttttccaagacgattctggtctgttttgcaataaacggaatttcatccggctgcacataagactgaccttcttttgcataaagcagacgttcaatcacttcatctccaacaacggatttttcaaagatttcttcacagtcatcttcttttacttttatgtactgaatgacatggtcacctttctggattcttaccagcggaccaaattcacagaagccctgacatccggttctttttacgcccacatgttctttctcatcatgtggtccaaattcaatggtaacacccggtgcgccttctgcgattcccagcatttttttataaattttttcggaaccggttgcaatacagccggtgcctgaacagactaaaatacggcagttataagcatttaactgcttttctgctgattctctgcatttatcaagttccgctctattcgtaattgtcatgcgccttcacctctcaattcttccaacagctcaatcactttttcaggtgacatttttggatgaacatcttcgtttaccatcaaagtaggagcaagtccacaagctccgagacaggaaacggtttcaactgtaaacatcatatcttcggtggtgtgtttctttttgcctaatcctaactgcttatacagttcttccagaattggcatggatttacgcacatgacaggcggttccgtcacagactttaatcacatattttccttttggttcaaaagagaagttctcatagaaagttgcaacactgtaagcctttgcttcggttactccaatctgttttgcggtataagtaagaagttctcccggcagatagcggtactctgcctgaatatcctgcataacaggaatgagtgatgacggttttttaccatatttttcaatgattttgtccgccacttcgtagtatgactggtctaacatacaatacctccttgttttttatatttttaaatttattatttccacctcttctgtgttacaatgattatattatacaccattttcacattttgcacaattattttcttaaaatttatcaatttgtatttattttcacaatatcatttactttttcaccagttttgtgttatactacttctgacattattactgattgttaaggtttttcctgcgcaagaaggcatcaatgtgtataattctgtatcattgactcgtctgtctgcgcttttgcgcagattttttttttgttcttttattgtcaaagaaaggaggattttttaacatgcaggacaccagaattgctttacttggaattattcttacttctcatgattctgttgaaaaactcaatcatctgctcagccagtatagttcttatatcattggacgaatgggagtcccttaccgggaaaaaaatatttccattatcagtgtcgcccttgatgctccaaatgatatcattagttctctttccggaaaaatcggaatgttgcccggcgtcagtagtaaaacaatctacaccaaaagttaatcactatcattttatatggaggaattaaaaatgtatacttacaatccggcatccacaattgcggatgaatttattaaccatgaggaaattttagaaactcttgcttatgcagacgagaataaaaataatgaagcattaatcgactcgattcttgaaaaagcgaaactaagaaaaggtctgactcaccgtgaagcttctgttttacttgcctgtcaatctgaggaaaaaaaccaggaaatctatcacctggcagagcaaatcaaaaaagacttctatggaaaccgtattgttatgtttgctccgctttatctttccaactattgtatcaatggatgtacttactgtccttatcatgcaaagaataaacatattccaagaaagaaactgactcaggatgaaatccgaaaagaagttatcgctttacaggatttgggtcacaaacgtcttgcccttgaagccggtgaagacccaaaaaataacccgattgaatatattctggaatgtatcaaaaccatttacagcatcaagcataaaaacggggctatccgccgtgtcaatgtcaacattgccgctacaaccgtagaaaattatcgcaaattaaaagaagccggtatcggaacttatattttattccaggaaacctatcacaaagaaagttatctggaacttcatccaaccggaccaaaacatgactacaactatcatacggaagcgatggatcgtgcaatggaaggtggaattgacgatgtcggtcttggtgtcttattcggtcttgataaataccgttatgaatttgccggactgttaatgcatgctgaacatcttgaagcaagattcggtgtcggtcctcataccatcagtgtgcctcgtctgcgtaacgcggatgatatcgacgcttcttcttttacaaatggaatcagtgatgatacctttgcaaaaatcgtagcctgtatccgtatcgcagtcccttataccggaatgattgtctccacaagagaaagccagaaatgcagagagcgtgtgcttcaccttggtatctctcagattagtggcggttcccgtaccagtgtcggcggttatgcggaagaagaaccagaggatgaaagctccgcacagtttgatgtcagcgataccagaagtcttgatgaagttgtcaaatggctgatggatatggaatatattccaagtttctgtactgcctgttatagagaaggccgtaccggagaccgttttatgtcgctttgtaagaaccagcagattcaaaactgctgtcatccaaatgccttaatgaccttaaaagaatatctggtagactacgcttctccagaaaccaaagcagttggtgatgccttaattgaaaaagaactggtcaatattccaaaagaaaaaatccgcaatctcgtagtggaacacttaaaggatattgaaaatggaacaggaaatgatttccgattctaactttacgtattttccattttattgacgtaggatgattcttcctatacaaggcagcggaacgaagcgtagtgggttctacggtgagcgacgctaacgtagtagatggagaatcagacacgtctacaaaggagattttatgacaactaatttaaatcaaaccccttcggcaaatcgtactcatatcggcattttcgggaaacgaaatgcaggaaaatcaagcctgatcaatgccattaccggacaaaattatgcgattgtatccgatgtacttggcacaactaccgaccctgttttaaaatcaatggagctgcttcctttaggtccggtcgttatcattgatactcctggacttgacgatgagggagaactcggggcactgcgtattcaaaaggcatatcagattttaaacaaaacggatattgccgtacttgtaattgatgcctcctttggtgtcacaaaagaagattctgagattttaaaaagaatccacgaaaaagaaattccttgcgtgattgtagtaaataaatccgatatctgtccaaactgtaacttagaagatttaccgcttccagattcagattctgccattttagtcagttccaaaaccggggagcacattcatgaattaaaagaactgcttgcacaacaagcgtcacaagataccattcaaaaatctatcgtcgcagacttattaaaccctctggattttgttgtacttgttgttccgattgattctgccgcaccaaaagggcggttaattcttcctcagcagcagaccattcgtgatatcttagaagcaaaggcaagtgcaatcgttgtacaggaaaccgagctggcagagacattaaactcacttggaaagaagcctaaaatggtgattacagatagtcaggtctttaaaaaagtatctgcagttacaccggatgatattttactgacctcattttctattttatttgcgcgctataaggggaatttaaagattttggttaatggagcttctgcactggattctttaaaggatggagaccgcattttgatctcagaaggctgtacccatcaccgccagtgcgatgatatcggaacagtaaaacttccgaactggattcgcaattatacgaaaaaagaaatcgaatttgaatttaccagcggaacagagtttcctctggatttatcttcctataaaatgattgttcactgtggaggatgcatgttaaatgaacgggaaatgaaataccgcttaaaatgtgccgaagatgccaaaattccaattaccaattatggaacttgcattgcttatatcaatggaatcttaaatcgaagtcttgagcctgtgaaagatttcctttaaaatttttttatctcaaaagaaaaaaccggatgctctcttatcgagaaaacatccggctttttcctttacagaggttattttatttggagtagaacaaccttgtatttttaaccgtgttcttttttacttttcttcttcatcctttcttgatttttttcttgctttccaggaaaatccgccaactcccatagaagttactgcaagactaatccatccccagatacttgtcgggtcaccagtctttgcattgctgcttgtagaagtagttccggtagatttacttcctgttgttcctgtgcttgttgtgcctttgtttgttgtagcagttgtacctgtagttcctttattggttgtagatgttcctgttgtagtacctttattggttgtactggtatttgtggtgttattgtttttattgttattatctttgttgtcgtcacctttattagaattatctacttttttcagtccatcaatcgctgtctgtaagtcttttgctgcattatctactgcttcctgagactctttcttttccagtgcattttctgctgtttccagtgctgtttttaatgcactccaggtttcgcttgtgtaatctgcttcttttaatgcttttgcagatgcaattactttttcaagttctgttgtgttaacttctgccggtgtttcactgtctgcttttttcagtccgtcgattgcactctgtaactcttttgctgcactatcgactgcttcctgagattctttgttttctaatgcgctctcggcaagctctaatgcacctttgaatacgttccatgtttcacttgtgtaatctgcttcttttaaatcttttgcagttgcaattactttctcaagttctgttgtgttaacttctaccggtgcttctgcttttacaagtgcttcgattgctgcatttaagtgactggttgcttcatctactgttgcctggctgtgttttgctgccagctcctcttttgcttcctgtaattctgtctgcattgctgcccaggaatcactggtgtaatcactttcttttaatgcttctgcttttgcaattgctgcctctaattccgttgttgagatctcgcctgcttctggttttacaatgttttcttcggttgcctggaatttgtaagtgtaatcttcatatcccattgcgtataaggttaattcccagtatccggttccgtctgttcctgacggtaactggcaacgaagagaatcggttaaaccaagctggatttccatggatttatgcatccagttatctgctgcaaatttggttccatagcttgcaagggctgttgtataagtactgtcatttccataatatgtccaacgggttgcatacattcctgctcccagtccaccatagtttccatttaagtctactcgtaagaattcaccataagaaccatttgctttttttacttctggttcgattccttctgcaacttttaatgcgttatcttttaatccggattcacttccggttactcttgcaccaaagctgaagcttccgtcagcgtttttcgttgcttcttttaagccattcgtcttatcagttacttctgcaacttccgtatatgcctgcaaattcttttcagagaaaccacctgctaatgttccggcattttcgactacctgatactgtttgctaaattctgcataatcagaagcttttacttttaccggtacatacttgattcctttgacttcatagtctttcatggttgcagttttttctacaccattttcggtataagtaattgttcctttgctaaatgtaatcactctgccatctgttaaaactgcttcagaagaactattccagtaagataccggatattcatttccatctgtatcataaataactgctgtgcactgataacttcctctgtgcagaccgtggtttgttgttgctcttgatacagtatcaaatgcacccttatctaactcaccttttttatctgctacgtcggaagaagaagtaagattacttccttctgcaagataaacaccttctgatgcccagtattctgcccagcttaatcctgcgtatacatatttgtattcctcttcagaagctgctactgtataagtaaactctaaatctttgtatccggttgcacttactacaatctgataatctcctgttccgtttgcaaatggtgcagcatctgtcttaatgcttccatcttcatttacaatgacagttgcgccacgtccgcttgctgcatagcttgttccatttacagaaacacttgtaatactctttacatattcctgtaaatcttctgctttaaatccatctgcagttacaagtgctgtcttttctgcatcataagttgccggcatgtcttctgtctgaagcataaagtctgcactcatatctgcatattttccttttttatcttttacaactaatgtatattttccttttttggcatctttaaatttcagcactccattttctacgcttgcatcaagtccttctacactgtactgcgcatcaaaatctgccggaaggttttcaaagttaacctttgtttctccactttttacagaggcattatctacagataaggttgcagatgtttttaccggaacataaatgtcatctaaatccatttcatagataccatttgttgtataataagttactttatcgatggtttctcccatcatctgtgcataatgtgcagaggaagtcgggcagccatgtacacttgtagtaaatccggtgcaccatgcaattttgtgtcctttccatacattttccagatgacgcataccatagtcatgaccttctttcgtgctgaatacaacggcactgatttcatcggtatcaaatgtaattccatctaaattcagctgataatccccatatttgcttgttgtcttaaattctcctgttacaccacttactttatttacggtgccctgtacttttccaaagcttacatttccgcttgcatctaccgttgcttctttgtagtaagccggtgcttcggaaagtacataataagaatagcttgcattttcaaataatgcatcttttcctgtataagttgtttcttttgtctgtccacggtttgttacggaaatggttacagagtcagaatctgttacctgtttaaatttagataaatccattccttccggaactttaaccgggaatacaatacccgtaatatcttctccgccctggcttacatgataagaaccgcctaccatactgcttgttcttgtcttgtttaaggttgcggaagaaacggagtcaactgctacactgttatttaattcggatgcatagaaatcagcatacggaatgttcattaaaacatattctactttttctgttggagtaaccggtgctgcttccaatcctgaaattgctgtctctaattcacttactgctgttgtcactgcatcctgcgattccttctttgtcagtgcatcttttgctgctgttaacttagtctgcattgcattccaggaagcctctgtatagctgtctttttgtaatgcctctgcttttgcaattgcactttccagcgctgttgtatcaatctttacttccgcatccgctgccggtgcactcttaattgctgcaagtgccgcttctttgattgcctttgaagtataagtcgctcctgatacggtatcccagctgttaattgtgctttctgttgcactctgatttaacaactttgtgcgaattcctactcgtttagaattatttgcatttaccgcccactcaagataagttttgctttccccactatcataagttcttgacggagttacagtaatttctttaaattttccgttctctaccgtaaggcttacctcaacatcatactctgaccatccatcaccatcaccatcttttgcatgtgttgtctgagtataagtgccatcctttgctacttgttctccacttgctgcataaacagatgccggtgccattcctgttaccatagatgctgtcatcacagctgccagtgcttttgtctgaaattcattctttttgctcataggttcctccttttaatgttatagcatctatcaaaagttagcattttctaacttttaatcaaaaaaaattaatgattgatgggagctgtttttcctgctattttcaagcactcccagatttttgctgccgtaattccaattaaagtgccggtgacagccccgccaattaatagtgccggtaaataataaatcaaatgaacgttgctcactacaagcattgccgctgtaagctgtgcgatattgtgagccacacctccggcaacactgattcctaaaatggaaaatccaccggcttttttcaaaatcagcatcactgccagactaaacattccaccggcaatactgtaaatcaaagacattccatttccaaataaggttcccacaagaaggattcttaaaacagaaactaagaatacttcgtgtggtttcaaaaaacataaaccgactacaattaccagattcgcaattccaagtttgattccgggaattccaaaattaaatggaattaatacttccacataactaaaaatcatagccagtgcaattaacatggcgcaaagtgaaatttttttactcacaaattttctcctgacatctatcggttaaattccaagccacatgaaaaggcaaagtaaaagaactgccttaaatacagtaaatccaatttcatttccttttaatatgccaacaccacaggttacatttcctttcggacagccatcaatacatttctggcactggaaacattcaccctgtacgatacttgtttttgcttctcttaactcaatctttgcaggacagcttcttgtacatttactgcatccttttatacaactttctctttttctctcaagagaaaagaacggtaaaatcggaagcaaagaaaaaattgctcccatcggacaaaagaatctacagaagaagcgttctatgaatgccattccaatcataagaagaatcagcaccgcaattccgattttataagccgaaagccggaagtttcctgcatgaatcatggaaaatacatcccatggacttgttcctcttgcatttccatagacgccaaagaagcacgcaagcacaatccctgccagtagtacatattttagtaaaatcagccattgctcccattcttttttcagggaaaccggttttttcttaagttttttgcagatttttaaatagattgcatgcagtgcgtctcccaaacttccaaatgcacaggcaaatccacaaaagaaacgcccaaatacaattgtatacgcacataagacaagtaaaactgccacaaaggaagtcaactcaatctttgcttccactccaatctgcgtaaacatatattttacgccaccaaacgctgcagtaaaggctgatggtaaaaacaggaaatataacaactgaatcactgcccgaagccaggtatttaattgttttttttgtttttttgaaaggttttttacatctatctttttcattctacctacaccgcctcttctaatgctgcttccaccgcattgatgattccggtagaactaaatgttgctccgcttatcgtatcgacatcggctgactgagcctcaattaaatttggaatcacatccattgccattgtcagataagctccatcttctttttccgcagataccacttcaatatccgtaatttcaccattttccacagttacttttacttgaatcggtccgccaaatccatcagcttctccttcataagtgccgtctttataagcaccttcgctttcctctgaagcatctgcatccgcctgtgtatcttttgattttccctgcgcaacctgttcttctgcattttttcttgcaagtttctcactttctaactgtgcatctaattttgcaatttcatcagttttctctctgttcgttaaaatcccgttataaccgacaattgctacggcaatcactgccacattgataaatctgactaaaagtgatttcatggtgtttcgtctcctgtattttcttctgtattctgattggagtcatcctgacccgaatcctctccagtatcttcaccggactgtactttttttgctgtctctaatgcaaggttacagccctctaaaatggagtttgaagaacaggttgctcttgaaaccgtatcaatctcttccagcgttccttttttaaggatctgtgttactactccaggaagtttggaagttccctgtactgcccgttttatgtaagcgtcattgtctgaacttccatcacctttaatttcggaaatatctgtaatcttatcttttgaaatcgtaactttcattgtaagactatatgcttcaaaatctccatcttcatttggaaggcacggtacaattacggtatactctccatcggcataaatatatttcgtttcatctggattttcattatctccattatttccgccattggtattgccgttattatcgtttccgttattggtatttccgttattgttactgttgtttccgttattattattgccgttgttattgttgcttccgctattattgttgttgttattctcgccttttgtcgctttctcagcctcttttagtgcttcttttaccgcaccgataattccttttgagctataagttgctcccgatacgacatccacatctactgtctgtttcttcaccatattttctgcaactgctcttgcacgtttaaagaaggtctcatcgtcattttcttctacaatcacaactgcttttaaggtcttatcctgaatgacaattgctaccttaatatcatcgagatagccttccgctattccataataaacaccctctttatatggaaattttccagcttctgctgttgtattgtcattgctgttattgccattctgtccgcttccatttgaggatgaattggtattctgtgaatttgaatttccatcagaagaaattgctgcctgacttaacgcatttctgactgcttcaataattcctactgaactataagttgctcctgatacggtatctacatttgtactttgagttgcaataatattggaaatcaatcccgaagcgctctgaatataactatctccatcggaggtatcaataatctgtatcgaagaaatctttcctccgcttatcactacttctaccgtaagtgctcctgaaaatcccgttcctgttccataatatgttccatctgcgtaggcagatgcatcctgtaccgttgagacagaagaagaaccacctgccggtgaagaacttccacctgaagcacctgctgatgttgatgccggtgttccgctgtctgctgcccctgtcagggcattttttactgcactgataattccatttgaactgtaagttgcaccggatacgacatctacctctaacgtctgtccggagataatcttatcaatgactccttttgcacgactgaagaacgcatcatcatcggcttcattttcaacgatctcaattgctgtaatctgcttatcttttacggtaaccgcaactttgatttttcccgcaaatccggttcctgttccgtaatacgttccatctgatacatcaaatgaaccttttgccgtacttttctgctcttcttttttgtcctcgtcttttttcttatcctcttttttctctttttcagctgtatctgcattctcctgttcagatgcatcctcatctgtctgatttttcgttgtttccggaatatcaaccgcataaaccggtgtggaatatccatgaagagaaacgccgatacaggcagctacaacaactgctgataatgccggtgccagactttttagtttcttcagtatgctcataaacttttgttactccttctttactacctctgtatcaaagtcagaagtaaaatcttctgcaataccctctgatacataaactttattttctttatcatataaaatcatatcaaattcatcactgtgtgctctccaatactcaattgccttatcttttcccataataaacagagaagtggacaacgcatcacacatcgtaccatctgcactcacaattgacaccgataataatccgctgtctgccggatatccggtagtcgggtcaataatgtgatgataagtaaccccgtcctgttcaaaataacgctcataaccgccagaagtaatgactgctttgtctgaaattgaaagcaccccaagatagctgtcatcatcatctacaccctgaatggcaaccctccatttacttccatctgtttttgtgccaagtgcctgtacatttccgcccagattcaccagaccgctttttactccacattcccgatagatatccataattctggtagaagtatatcctttcgcaattcctcctaaatcgatcgccattccatcggttttaaaagatacggtactggtctctttatcaaacacgacatccgataatttcgttttttccagaagactatccagtgtctctttagaaggaactttgaagtcacctgtggtaaatccccattctgccataatcggataaattgcaatgtcaaatgctccgtctgtggactcaccaaattccagtgcacgttccaccagataagaggcatcttttcccaaggttccaccgccattggcattgacctgtgcaatttcacttgactcttctcctgtagaaagcagtccatccagacgctcaatttccgtaaccgccttttctaccgcttcctctccatgacttccataagcagtcaccgtcatgtaagtatccatggcaaaaacatccttacttgcctcctgactttcatctgcttcaccatcggtactttcctcactgatgtcctgatttttcgcctcttgtgcctcttctttttgactgctgctatcggtgattttttgtgtactacaccctcctaaaatcattgtgcttaataaaaataatacaagtatcttttttttcacgttttttctccttactgatgttagagcctcctaactttggatagcttatcatcacttttattacttgtcaattatactctatacttattgagaatttttctcattttatcatatagccactgtttcatatattaaacagaaaaacggtatgctgtcctctctcgactcacataccgtctcttttatttcttatttttttattttaccgcaccaattaatgtattaatatcatcaatctggtttttctttaaatactcttcgattcctttaaccgtctcaactgtcgcataagggtttgcaaaatttgctgttccaatggaaactgctgttgcaccggctaagataaattccagagcgtcttctgcatttgagattccacccattccgataatcggaacatggactgtctgagccacctgataaaccatacgtacagccacaggtttgacacatggaccggacattccgccggttttatttgccagcgcaaaggtacgacggttaatatcaatcttcattcctgttaaggtgttaattaaagaaagaagatctgcaccgcctgcttctgctgctcttgccatctctgtaatatcggttacgttcggacttaacttcatgataaccggctgttttgcatattttttcacttcttttgtgattgcctctaccgcttttggattctgtccaaaggcaattccgccttcttttacatttgggcaggaaatattgatttctaataaatcaaccggttcatctgccagacgttctactacttcacaataatcttctgtactttttccacatacatttacaataattttcgtatcaaactgttttaagaacggaatatctcttttgcaaaatacatcaattcccggattttggagtccaattgcattgagcatgccgccgtaagtttctgcaatacgtggggttgggtttcccgaccacggtacattcgccacaccttttgttacaactgcacctaactcgtttaaatctacaaattcactgtattctgcgccagaaccaaatgttccggaagcggtcataaccggatttttgagttctacaccggcaagatttacttttgtattcattataattctacctccgtacttaagaacaccggtccatctttacaaattcgtttgttgtgtacatgagaatgagaatccacgtctttagactgacatacacaggcaagacaggctccaactccacatgccatcttctcttccatggaaatccagcaagggattcctttttccagtgcataattttttaatgcacgaagcatcggttttggtccacaggcaaacatcatatctgcttcgatttgattttcacgaattgcgtctactacatttccttttgttccaacactgccgtcttccgttgcaataaaaagtgttcctgctgattcaagttcttcttttaagaataaatcctgattgcggtatccggatacaataatcgcttctccttcgatttcttttgcagtctgaagcattggaggaacgccaattcctccgccaatcatcagcacttttttaccttttgcttcttcaatcggaaatccgtttccaagcggacctaagatttcaaaagaatctcctgcttctgctttggaaaattcttctgttccttttcccactacacgatatacaatacgaagtgtgcccttttcgcggtcaatttcacagatactgattggtcttggaagcacacggcttttatcattactatagacagagataaactgccccggttttgcctgtactgcaatttcttttgcatcaagccacatactgcagattccatctgcaatcatcttctgctcgattacagtacttttcatctttaactttgccatgattttctccccttattttaatgctgttaatgcaccatcaatatctgccaccatagtttctacggcttttctggatgcatctgcaaaatttgcctctccaaactctgcatactgttcctgtttataagctgcaataattccgcgggaagagtttaccactgcaccaagtccgtcttcattaaagaaatgaaccaagtcttttccttttccaccctgtgcaccgtaacccggtactaaaatataagattttggcataattttacgaagcacttttcccatttccggataagttgcaccgacaactgccccgatataactgtattcatcgcccatgcagtcagcgccccactgagcaactttctctccgactaattcatataatggtcttccgttaattaactggtcctgaaattctccactggatggattggaagtcttaactaaaataaacagaccttttttctcttttttgcagatatcgataaacggattgacaccatctgaaccaagatatggattcactgttgcaaaatcttcatcaaagcctgcatactcttttgttccaacctgaacttttccaagatgtcctactgcataagcagaagacgtagagccaatgtctcctcgtttgatatctccgattacaaccaaatctttttctttacagtaatctacggtctttttaaatgcaaccagcccaggaattccaaactgttcatacattgcaatctgcggttttactgccggaatcaaatcataagtcgcatcaataattgctttattaaactgccagattgcttctgcggcaccctctaaggtttctccatattctttaaatgcagtctcctgtacttgttttggcacataagaaagcattgggtctaaacctacgcaaatcggtgcatgagtcttttttattttttctgtcagtttgttaatcatttttcttcctccatctttttgtgtcttatattgttctatttatttaaaattttttgctgcttcctgattcatataagcaatcttgccatcgcagatagtcgcttttaccattccttttactttccagccgttaaacggtgtatttttcccgcgggaaaggaaagtcatagaatcaatgacatactctttttcagggtcaataattgtaacatccgcaggagctcccacttttaaagtacctttattcgaatgaattacctgtgccggattatagctcatcttttctgccatctgcattggagttatgattcctttttctaccagttctgtaattgtaagtgcaacagaagtctccaatccgacaattccaaatggcgcatcttccataggctgatttttttcatctctgctgtgcggtgcatggtctgtactaatcacatcaatgatatcattttttaatccttctaataatgcttctttatcctctttggtacgaagcggaggattcattttatagtttgaatcatctttatcaatttcatcagaagtcaaagtaaaatgatgcgggcagacttctcctgtcacatccagcccttcttcttttgcaaggcggatcatttctacgctgtcttttgtagagcaatgacaaagatgcagttttgctcctgcttcttttgccaataagatatctcttgcgacaatgacatcttccactgcattgctgattcccggtaatcccagttcttttgtatattcatcggaattgacacagccctttgcttctatcaggcttttatcttcacagtgtgcaaataccggaatgttgcactcagcggcaatcttcattgcctctttgtataatcctgcattcattacactttttccatcttcactgattgccggaatcccggcatctgccatttctttaatttcggcaagttcttctcctgcctgtccttttgtaaccgctccaatctgaagtacatgaatcggtgccatctcttttgctttattatgcacatattttacgcggtctgcacagtcaatgaccggcttggtatttggcatggcaagaattgtggtaaacccaccctttgccgctgctttggagcctgacacaatatcctctttgtacgtaagtccagggtcacgcagatgtacatgaaggtcaatcagaccaggcattacataacagcctttggcatcaattaccttatcctgttttgacggattgatttcatcttttatttctttaatctttcctgcttcgatatacaaatcacttatcttatctgtctttgttgcggggtcaattacccgtccgtttttaattaaaatgttcatggactctcctctcctccagcgccttctctgcactctcatcttcttacaaaatcaagtacagaaagattttgagaatacattttattctcttttggttttaatagtaacatacacaaattctttcgtcaattatacttttttccttgacttttaaggcatttttgcatatactgaatcttgtaatgaaatattggatataaataatgaagtgcatttcacaagcttctgattattgtaaattaagcggtttttagagattgtattattttatttataatgaatatactctctaaagaccgctttttattcatataaggagattttgaaaatcctgctttcttttgtttctatccgaaattcaactacttattttttttattttatggaggtaacattatgaacaagggaactgttaaatggttcaacgcagaaaaaggttatggatttatcacaggagaagacggacaggatgtattcgtacatttctctgctatcacaggtgaaggattcaaaactttggaagaaggacaggctgtatcttatgatttaacagaaggtgctcgcggaatgcaggcagctaatgttgttaaattataatttataaggtatctgaatcatttgattttcttataaacagcacaaaaagcggctgtcacatgaaccatgtggcaaccgctttttcttcacattaaatcaaatgtatctgggactccacacattattctgcatctgttgtattcaaagaacttaaataatccgtgattgcagttacatccatctgagtggttacaacttctgcattttcatccggtgttgtgacaacctgatatgcagaatatccaatccagccgactaagagcagagaaacaattgtaattcccagcttttcaacgagtgtcatactctcatcatttttattttttctcttattttttccacggactgctttattttttttatactgatctactttttcctgactcatgttttgattcctcaactttctactgtctattcgctatgtactttctaccgtcatccatttttgcgacgtctgcgctcattatagcacgttttcttttttctggctacaccaaacccagcgttttcaaaagaaagagccagccggtcagagtaaatgccgaacacagtgttgtcaccataacaatactcgaagtcagtatcccttcatgtcccatatttcttgccataacaaaactgctgacggttgtagctgaaccaagcatcactaagattgcaaccaactctgattcacgatatccaagccagactgcaatcggcaaaaaaatggctgcaagcaccactaattttaaagcacttgcaatgagagtcggttttaattttccaagtgccttttttccctcgaaagaagctcccatcgccataagaccaagcggagttgcaagcactgccatatttttcactgttttttgcagaatctctggctgtggaatttttaaaattgcccacacaaaacctgctgcaattccaagaataatcggattcgtaacaattccctttaaagttttttgtaacagggctttatccatttttctctgtcccggttttaacaaagacaggacgattaccgcaaacgcattgtaaagcggtaccgttccgataatcataagcggtgccattccggatgtaccatagatattctggataaatgcaattccaagaattgccgcactgcttcgatatgctccctgcacaaattctccacgttcttctctttttacgacaaagaatgacaaaaccgtcactcctgtaatacttaaaaacgttgcaataaaacagaacaatacaaacccgccattccagctttcacgaatatcaactgctgaaatatcctgaaacaaaagagccggaagtgccacagcaaaggcgaatttattcatctttgccgaaaatgcttcatctatcagcccgactcttttaaaaaagcttccaagaagcattgtaaaaaagataggaagggttgcatttaaactaaaaatcagattatccaacgtctcagtcttcctttaccagcactttcaggatttctgaaatatacatggtatgataatctttctgtggataccattttgtatcaattgtttcatcttcaaagttttccggaagaatgtctccatgatacattttcttgcacactaaaatcagatttgcttcttcaaatgcagctgttccatccacaaagtatggagttaaaccagcttctttgattttatctttgtcacgtccggaaacacttccacagatatttaatgcttttctgtacgattcatcaaaaaatgaaatcgtaaacgtatcatttgcatctacaaattcttttgtatagcgctgtgggcgaatataagtcgttactgcattttttccccacataataccgacgccaccccagcttgcggtcattgtattgcatttttcttcattgcctgcagtaattaacatccattcttttccgatttttgtaaatggattcatctgcaattcttctgcttttacttctttaaatgccatgatttgattctccttgtcattaaatttttattgtcaaaaacatatttatctgccgtataattttgtcatacggcggattttctcttttaattcttcggaaaatgccccttttgtcattctccatttccagttgtctccaagcgtggacggcatattgattcttgcctcacttccaagtcccagaaaatcctggaccggaataatacaggtatctgctgtacttctcatcgcaagtgcaattaaatcccagtgctgttcttcctttggagtgtaaaaactattcatgtaacgcagggcaacctctttgtctccatcggaaagtttctcaaaccagcccgctgttgtatcgttatcatgtgttcctgtataaaccacacagtttctctgatatttataagtcagataatcactgtcctcactcgggtcaaaagcaaactgcagaactttcattcccggatatccgctgtcttttaagagttgaaatacactctctgtcaaaaatcccaagtcctctgcaataatatcaagttcaccaagcttttctttgaccgtgttaaataaatccatacccggacctttttcccagtgtccgtttacggctgtctcatctccataaggaatcgaataatattcgtcaaatccacggaaatggtcgattcttacaatatcatataaatcaaagcagtaagcaattctcttcaaccaccagtcatatcctgttttcttatgatatgcccagttatataatgggtttccccaaagctgtcctgttgcagaaaaagcatccggcgggcatccggccacaccaagcggaagatttttctcatctaactggaataactccggatttgcccaggtatctgcactgtcaaatgcaacataaatcggaacatcacctacaatctgaattccctttttgtgtgcatattcttttacttttgtccactgctcatgaaactcatactgcaaaaattcataaaaattacattcttcttccagttcttttttataatattctaccgcttccggttttctaagacggatctcttcttcccactcaatccagctttttccatcattttgatttttaagtgccatatacagtgcataatccgggagccagtgttgattggctttacaaaattctgtgaatttttcatcggataatatatcagaatttaaaaatgcctgttttaataatacaaatctggaattataaattcttccataatcaatgtaggattcattgtctccataatcagaagcttcgcaggcttcttttgtcagccagcctttttctgccagtgtatccagatcaataaaatacggatttcctgcaaacgtagaaaaggattgatatggggaatctccatagctggtaggaccaagtggcagaatctgccataatttttgtcccgtctcttctaacaagtcaataaattcataagcttcttttgaaaatccaccgattccataaggagatggcaggctcgcaatcggaagcagcattccgtttcttctcatttcaatttcctcattcttcatattgtatttttattaatgtaagccctcttgccggcgccgttgctccggctttttttctgtctttcgcctctatgatttccaacatatcctctggttttcttgccccgcttcccacttcgattaacgttcctgcaagaatccgtaccatattataaagaaaaccacttcctgtaatccgcatacagatttcgtcgtcctctttttttatctgaaaatcataaatggtccgcactgtcgttttgacctgtgcccctgctccgcagaaactcttaaaatcatgttctccaagcagatattctccggcttttcgcattttttccacgtctaatggaagataagtaaaatgagaatacagccgttttgtcggaaccggaaattttttatttaaaatccgatattcatacgttttcctgctgtttcgataacgaggatgaaaatccggttcaacttcttttgacatctgaatccgaatgtcttccggcagtctttgatttaaggcataagaaattttttctcccggcatccttgcacttgtatcaaacacagctacatttccaagtgcatgtactcctgcatccgtacggcttgctccgatggtttcaatcggctcttttagtaattccgataacttttggttaatcacttcctgaactgtaattccatttggctgtacctgccatccacaataatttgttccgtcataggcaatttcaagcatgacccgtttcatgttctattcctcctctgactactctcacaggcaaacctgtgggtttttgccactaatttataacaatatactcaaaaaatcccgagagtacattatactataatacgcaatacaatgtcggcaatcagataaaccagtaaaaccagatatgccataatatcatgattctgatattttaatggtttcatggatgtacgatggtctcctccatgataacagcgggcttccattgccattgccaaatcatctgctcttcgaaatgccgaaataaaaagcggaactaacagcggaattaaatttttcgcttttttgattaaatttcccgattcaaaatctgcccctctggcaatctgtgctttcataattttatccgtctcttccattaaaatcggaataaaacgcagtgcaatcgacatcatcattgcgatttcatgaaccggaactttaattttgttgagcggacgcattaatttttccagaccgtcggtcaactggtttggtgtcgttgtcaatgtcataacagaagaacccatcaccagataaatcagtcggattccgatttttatcgcctgacggattccttcttctgtaatctttaaaatccaaatctgtacaaccacttttccgggaactaagaacaggttaaatgccactgtaaggataaaaataaaaaacaatggctttaaacctttcatcataaatttaaccggaactttggaaagtacaatcaccaccgctaaaaatgctgtggccagcagatacccccataaagaatttgcaacaaacagtgagattaaaaatgcaattgttcctacaaatttcactctcgggtctaagcgatgcaaaattgattttgccggataatactggccaattgtgatatcttttatcatagtatctgtttctccagtgctcttaaaatacttctctttgcttcctcaatcgttgtcgcatttgtatcaaccggaagaccttttgcctgcagatcatgcatgatataggtaatctgcggtgctgcaagccccattgattccaattctttataatgagaaaagacttcttttggcgttccgtcaaatgctttttcccctttattcatcacaatcatgcgctctacatattttgcgatatcttccatactgtgtgaaaccagtaccaccgaaatttttcgttcttcgtgaagcattgcaatctggtctaagatttcatctctgcctcttgggtcaagacccgctgtcggctcgtctaaaatcaatacttccggctccatcgctaaaactccggcaattgccactcttcttttttgtcctccggaaagttcaaatggcgaacttttataagatttctctggaaatccaacatgcgcaagtgccattcttgccttttcttctgcttcttcctgacttgctccaagattttttggaccaaagcagacatcggtaagcacatctgtttcaaacaactgatgttccggatactgaaagaccagcccgactttactgcgaaggtttcgaagcggatatccctctttccagatatcttccccattataagaaacaactcctgaagtcggacggatgagtccgtttaaatgctgaattaacgttgattttccactgccggtatgtccgataactcccataaactgtccctgcggaatctccagactaacgtcttttaatgcatgcatctcataagcggttcccggactgtaagtataggttacattttctaattttatcgacataatgcactcaccagttcctctcttgtcaatattccatccggtatcggcacacctgcctgtttcagttcatacgccaacaaagtaacctgcggtacatccagacgataggattttaactcttctacttttgaaaatacttcccttggtgttccctgcatgacaatttttcctttatccatgacaaatactttatccgccaaagtcacttcttccatgtaatgggtaatcaaaacgactgttatgcctttcttttcgtttaattcctttaccgcctgcagcacttcttttcgtccgtttggatcaagcatcgccgtaggctcatccaaaataatgcactttggctccattgccatcacaccggcaattgccactctctgtttttgtcctccggaaagtttattcggagaatgacttctatatgccgtcataccggttgcctctaaacttttattgactcttctccagatttcatccgtttccacacccatattttccggaccaaatccgacatcttcttccacaatcgaaccaataatctgattatcgggattctgaaataccatgccggctttctgacgtactttccagatttcttcctccgtagaagtattgattccatctactaccattgcaccctctgttggatataaaagcgcattgatatgctttgccagcgtcgatttcccggaaccattatgtccaagaactgcaataaactgtccctgttcaatatccagattaatgtcatcgagcgcacgatgtgtttcttctatatgtccattttcatcatatttataataatcatgcattaactttaatgctttaatgattcccatcgtctatcctctctcttgtaacactctgtcatttccacatacataccgataaacttctatttcttttgcatcctgttccacatgataatcgatttttaaaaatcccagtttttttgccagcgcaatggatgatttgttctccgaatgaatccggcagtaaagatactttgcgcctcgctctttggcttctaaaagaattgcatggcaggcttcatatccatatccctgtctttgataagcttcatcaatcagataacccagttccacaacagaacgaccctgattccagattttcggttcgattcccactcgtccgataattttaccactttgtttttctatcactgcccaatagcccatatcacacaattcatacatatatcttcggtaacttgggaagttttcgatttcttcttctaatgtcttttcctttccctcaaccgcattttctgttgaattctgctcatttaaagcaagcatttgtggtaagtccgcttctgacatttcccgaactaaaagtcgtggggtctcacataccactgctggaagatggtgattgtggcaataaactttttccacaaatctggcatcaatctcttcatagccttcgattatcattgccgcctgacttaagtcctgctttcctgaatccggattaaaatatcccatacaggttatatttgccgcttttgctgcacggcatccattggtagaatcttccacaaccagacattcacttacgtctaattcaagttcctctgctgctgccaaaaagacgtccggtgccggtttcggatgctttacattctctccacttaatattttatcaaagtagtgccgaatatttaaacgttttgtaaccatttgaatataagaaagcggtgaagaagaagcaatcgccattttgtatcccgcattttttaagcgttctaacaactgtggcacgccctctatcatcgggataccctcccgttccaccgtttccgctttaatctttttcatggtatccactaatgccttatcttctctgtcaattccataggtttcatgaagaagattcataagaaatccaagtgtagaaccaatacaaggtttatagacctcataatccaattcaattccacgtgttaaaagtgcttctttccagatacggtaatgtactggttcactgttgatcagcactccgtccatatcaaatataattccctttaacatcctttttctccaaactttaaaagggtactgctttttcacagcaccctttctattttttcaggcattgcacggtgtaaagcgttggaatgcttagctgctataaagcggacattcgcaatccgctttgctacttgctcatgaacgcagtcgcttcgcgctctgtcagtgggagctttcaactcccactgacagaagcatccccctcactcgccgcttagtgctccgcgcacttgaagcagtggaatgcttagctgcgttcaaacagcaattcatccataattttccagatttcttcccttccctgcttggtttcggctgagaatggaatgacctgtgtgcccgcaagcagctcgagtccttgtttcaatgccttcacgtgtttctgtacctggctgcgttttaatttatctacttttgttgcaataataatcggctgataaccattgtgtacaatccagtcatacatcattttgtcatttgctgacgggtcatgccgaatatcaatcagcaaaaagaccgcttttaactgctttgatttctggagataacgttcaattaattttccccactgttcttttactgactgcgaaacctttgcatatccatatcccggcaaatctaccagatacatggcatcattaatattataaaaattaatggtctgtgtcttacccggggaagcactggttcttgccagtgctttacgattcattaatgcattaatcaaagaagattttcccacatttgattttcccgcaaatgcaacctcaggtaactcagtatcaggaagtgtgctggtaattccacacacaatgtccagtgacacattttttataatcatacctgacctcccgtaaatgcttcttttattacttcttccatagagcttacaaagataatattcagtccgtctgtaatttctttttctaattcctctacatccggtttattttctttcggaacaagtaccgttgtaattccggcattttttgccgcaagcagtttttcttttaatcctccgatcggaaggacacgacctcttaaagtaatttcaccggtcattgcaagatttgcttttaccggaatttttgtaattgcagaaagcattgctgtcgccatggtaattccggctgatggaccatcctttggaaccgctccttccggaatatggatatgtatgtcattgtttttaaaaaattctgcatcaatctgatagttctctgcaattgagcggatatagctgattccgatctgtgcagattccttcatgacatctcccatctgtccggtcaatacaaactcaccctgacccggcatcagattcacctcgatttgaagcgtatccccaccaacactggtccatgcaagtccacgtacaatccctatctgatcttcttcatttttcttctggaacgtataacgcgctcttcctaaaaattcttccagattctctttttctactcttacacagctttctttttcttctaagatttttctggctgattttctacagattgttccaatctttcgctccagacttctgacacctgcttctcttgtataagcagtaatcatttctcttaaagcttcatcggaaatttcaagctgcgctgattttaatccgtgtgccttaatctgctttggaatcagatgttcttttgcaatatgccatttttcattttcggtatagctgctgacttcaatgatttccatacggtctaaaagcggacccggaatagtctgtaaatcatttgcagttgcaatgaaaagcacttctgataaatccagaggaatttccacatagtggtcacggaatttatgattctgctcagaatccagcacctccagaagagcggaagaagtatcccctttgtaatcactgctgactttatctatttcatctaacagcatcagaggatttttgactcccgcctgaatcattccatttgcaatacgacccggcattgcgcccacataagttctcctatgtccacggatttctgcctcgtcacgcactccgccaagactgattctgacatattctttattcaacgcatgtgctaccgattttgcaatggaggtttttccggttccgggcggtcctaccagacagagaatcggactttcaccttttttcgtcaatgtccgtaccgcaagaaattccatgatacgctcttttactttttccagaccatagtgttcttcttcaagaatctgatacgctccctgcaggttcttattatcgcgactggtcttgtcccatggcagagacaataacgtttcaatataggtacgtattacccctgactctgccggacttcccacagtatttttaaaccggttgatttcttttgtaatacgttctttgacttctttttttgcctttaatttctttacggtttctaaaaactgctccgcttccgttgcagaattatcttcgcctaattcctcacggatcacttttaactgttcccgtaaaatatattcacgctgatttttgtcgacacgctctttcactttggattgaagtcttgctccgatttccataatctggatttcgtttgtaagaatcattcctacaatttcatagcgttcctcaaggctgactgcctctaaaatcttctgtcgttcttcatagcgaatctgaatatgaattgaaatctggtctaaaactttttccacgttctctaattctaaaatctgaccggcaagttctttgctgatctgcttattggaattacagtaacgtacaaataattctttgatactgcgaagcattgcttcttttaccgtttcatctaagtcttcttccggctcaaaaaccgctatctgcgcctcaagataatttggattttcttctaaagaaaccagctgtgctctctcaattccttctactaaaactcgaacaatgttctttggaagttttaccaattgtttaatttctgcaattgttccaattggatataaatcctcttgaaccggttcttctgtctcaggatttttctgtgtaatcaagagaatcctctgatcctgcatcattgcttgttcaatcgcctgaatcgatttctctctgcttacatcaaagtgaacaatcatatcaggaagaatggtcgttcctctgagggcaaccgccggtaaatgatacattatgtcactcaattcccacacctccttattttcattgatgtattccgttcttatgctgtttccggtttattgcgtttgcgtccgcctttgcttcttcttgtcggaggctgcatttctccatgctcgagttcggcacttcctgttccttctaccacttctttggtaatcttgcaggaacggatggtctcatcggatggaatttcatacattaaatccatcatggtattctccatgatagcgcgaagtcctctcgctccggtttttcttgtcatagatttttctgcaatggcattaattgcggactcatcaaactctaattttacgccatctaattcaaacagtttttcgtactgttttactaaagaatttttcggttcttttaagatacgaaccagagcttctttatccagcgcatccaaagaaacaacaaccggtactcgtccgacaaattccggaatcataccaaattttacaaggtcatgcggcataacttcttttaacacatcaccgatatttcgttcttttttatctgcaatctcagtattaaatccgattgattttgtatccatacgggtttcaataattttatttaagccctcaaatgcaccaccacagataaataaaatattgctggtatcaatctggataaattcctgctgcgggtgttttcttcctccctgaggcggaacacttgcaactgttccttcaataattttcagcagtgcctgctgtaccccttcaccggatacatcacgggtaatggaagtattttctgattttctggtaatcttatcaatttcatcaatgtagataataccatactgtgcacgttctacatcataatctgctgcctgaataatcttaagcagaatattttctacgtcctctcctacataacctgcttctgtcagtgttgtcgcatctgcgattgcaaatggaacatttaacagttttgcaagtgtctgtgcaagcagagtttttccggaacctgtcggtcctaacatcaaaatattactcttctgaagttctacatctgaattactgcctgccaatactcttttataatgattataaactgctacggaaagtacttttttggcttcatcttgtccgattacatagtcatccagaaatgacttaatctcctgtggtttcagcagattaatttcatcgttcatcggttctgcataatctgcactttcttccgcacagatttctgcacagatttccacacactcatcacaaatataagttccgtttggtccggcgatcaatttacgcacctgctcctgtgtttttccacaaaatgagcagcggactttcggttcatttcctttcattgccatttcttttcctttctgttttacttctctttttaatggcgaaaagacccccgagccaaagcgcaggagtcttatcttttgtcttactttttatactcaattatgctgtcaatcagaccataagcctttgcctcttctgcggacatataataatctctttccgtatctctggcaacgacttcataaggctgaccagtatttgcagccagagtctcattcagtttctttttggttttcagaatcatatttgcaacgatttcaatctctgttgcctgaccctttgcaccgccagatggctgatgaatcatgatttctgcattcggaagagcaaaacgttttccttttgcaccacctgcaagaaggaatgctcccatacttgcagccatacctacgcagattgttgatacatcacatttaatataatgcatggtatcataaattccccatcctgctgaaactgaaccacccgggctgttaatgtataactgaatatcttttccaggatcttctgattctaagaacagaagctgagcaataataagacttgcagttgtatcatttacttcttctcctaaaaagataattctgtctttcagcaagcgggaataaatatcataacttctctcgcccctgcttgtctgttcaatcacatatggtactaaactcatgaaactcctcctattctgtcaaacaggttcaaaggactgattaagcctctttattctctacgacttctgttacttttgcagcatctgcaagtaaagtaactgcttcctgaacagctaaatctttcttcatctgttctttttcgtagtcacccattaattcatttaatttttcagctgtcattttatatgcttcagccatttttgcaatttcttcattgactttttcatcagaaatctggatatcttctacttctgcaactttttcaagtaccagacgtgtctggatcgtcttcatagcctgtggtcttaactgttcttccattgctgcacggtcagaacctgtgaactgatagtactggtcaatggaaagtccctgctgctgaagtcttgagataaagttgtttaacagctcttcaatctgaagctgaaccatagcttccggaatatccatctgtgcattttcaattactttatctactactttatcttctttttcacgttttacagctgcttcttttctttcttttaagttcttttcgatatcagctttgtattctgcaaatgtttcaaattcagaaacatcttttgcgaattcatcatctaattccggaagttcttttactttaattgcttttactgtgcatttaaatacagcagcttttcctttgaggtcttctgcatgataatcttccgggaaagtaacgtttacttctttttcttctccgattactgcaccaaccaactgctcttcaaatcccgggatgaaagagttagaaccaattgtcagcggataatcggttccttttccgccttcaaaagcaactccgtcaacgaatccttcaaagtcaagtgttaccatgtctccatcagcaactgctctgtcgtctacgtcgattgttctggagttcttttcctgttcttttttcagttctgctgcaacttcttcttctgttacgtctgctgcggatacttctacttctacacctttatattcacctaaagtaacttccggttttacagcaacttctgctgtaaagatgaaagattttcctttttcaatctgtacaatgtcaattgttggtctggaaacgatgtctaattcgctttcctgtgctgcctttggatattctgtattaatcagaagatttgctgcatcttcaaaaaatacacctactccatacattttttcaatcataacacgtggagcttttcctttacggaatcctggaatgttgatgctttttttgtttctgttgtaaacagtgtttactgctttttcaaaatcttctgctgatacttcaactgtcagctttgccatgtttttttcgagtttttctacctgtacgctcattttaaatgattcctccttgaattctatatgtattgatgcatattaggtattcatgcatttctgcccataaatagaccatttttcatacttacagtcattatcacagtatagcacaaggttttttaaaataccagcatttttttaataaacgattgatttttttatctgatgtgcctttacttcaccttctaactgactaatcagctccagcgcaaacgcaattgccgttccaactcctctgcttgttgtcacattcttatcacgtaccactgcttcttccgaaagaactgccccttttaatttttcctcgcatcccggatagcaggttgcttttctgccttttaaaattccatttgctccaaatactcctggtgcggcacagattgctgctatttttttgtctgcttcattaaattttatcaacaattcggttaaacctttgtgttctcctaaatgcagagttcccggcatcccgcccggcagtacaagcatatctgcatcactgtaatcgacctcttcaaataaccggtctgcactcactttaatcccgtgggagcccgtcacttcaagacttgttccaatcgaaaccataatcacttcttctccggctcttcttaacaaatcaacaacggtcaatccttctacttcttcaaagccctctgctaaaaacacacatacttttgccatgtgacattcctcctgtttgcttttttctcaaattatgatacgatactggtaaatgatatttcaatcatcttataaaaatcaaaggagcattttattttatggaaatcgaaagaaaatatctgattaaaaacctgccattttccctaaatgaatattcttttcacaaaattgaacaggcctatctaaacaccgaccctgttatccgaatccgaaaacaggatgacgattatatctttacttataaaggtcgtggacttatggtaagagaagaatacaatctgccgttaaatgaacaggcttactgtcatcttagagaaaaagccgacggcattattttatccaaaacccgctatcttattccttttaaaacttataccatcgaattagatgtatttgacgccccttatgaaggactgattctcgcagaagttgaatttcctgacgaatcttcggctaattcttttactgcaccggactggtttggagaagatgtcaccttttccaaaatttatcataacagtaccttgtcagccggtaaaacacaggagcccatttaactaaggctcctgcttttttcccttttgttttatctgtcttcgtatccgtctccaggtttcttcctgccttttatccagttctttttcaaattgtatcccatactttctctctaatttccagagataacattctaaaatcactccacaaaaaacacctgccagctttgccaatggattcttactcttccgacagtgttttcttaatcgaaaaattcgttccattttcatcccttctgtcaaaataaaaactattccatgattccttttcttttattttaacaggagagcttttgttttgcaatgttatatattgcaaaattatctcaatttccgactgagataacactccgtggggcgcacattgtccagtggacgatggttctgcgcggaccgtaacgaagtgtagaccgcagcgattctaagaagaatttgtcagcttgtgctgactagattcgtgcgccaagtctcacgaatgttcgacttgaatttttataactgttttgttttctttacacaggcacgaatactttcggaaactgcacttcgcatgcctctttcttctaacacaccaactccctctattgttgttcccgccggtgagcagaccatatcttttaactcacccggatgcatacctgtttctaataccatctttgcacttccatatacagcctgtgccgcaaattcatatgcctgttttcttggcatgccctctgcaactgctccatctgccattgcttcgataaacataaacacaaatgccggtgagcttccgctgactgcgccaaccacgtccagaattttttctgtcacggtatccgcacgtccaaaagaacgaagcagtaccagtgcatcttcaagttctctttctgtaacctctttattcgggcagacacctgtaatgccttctccaaccagcgccggtgtatttggcatggtacggataattttatgtcctgctccaaactgtgcctccaaccattccagtttttttcccgccgcaatcgaaataatcacctgttctgattttatttctgattttatttcctgaattacttcttcacaaaactgaggttttactgctaaaaagatcacatctgcatcctgtactgccttcttattatcgattgtacattcgattccaagtgtttcctgtacttttttagcagagttttctgttttcgtagatgccttgatatcctctttttttaagattcctttttctaatatcccgccaataattgcggttgccatatttccacagcctacaaatcctattttcatgtctgtcaaacctcctgtattgttttacaaactctcaaattctttaaatcaagtgtaataagaattctgagaatacattttttcttattatccaacgttttcttcttttttgcaagtattggctgtgttttttctcttctcaaaagtttgacagttgaacaagtaaaagctcagctttcaaatttttttactcttttactaaacgacagattgttatcatcactttttcaatatccaaaggtttcgccaaatgagcattcatacccacggcaatgcacttttcagcatcttcctggaatgcatttgctgtcatagctataatcggtattgtttttgaatctgaacgttctaatgacctgatttccctcgtagctgtatatccatccataataggcatcatcagctccatcagaattgcatcaaatgttcctgccggtttctctttaaataattccactgcctgctgtccatcctccactctggtaactaacgctcctacatcttcgagaactgtcttcgctatttccgcattcagctcattatcttctgcaatgagaattcttttcccttttattgtgtgaattgcagatgtctttatggcattccgacttccgtatacctcttcttttgatgccatgtcaaaagaaagatctaccgtaaattttgttccaataccctgtctgctttctacctgaatacttccacccatcagctctatcatggatttgataatagaaagtcccaaaccggttcccggcaccttgttttctgtagaggtatgttctctggaaaattcttcatagatatgcggaagatattcttcacttataccaatacccgtatcttcacatgagaaaatacaacgtatctttgaaggattctctgatactgcctcatgtatttctacatggattgaatgtccctccggagtatactttatagcattactgataatattcaacatgatctcctgtaactttgtctgatcacagacagcataatgatgtcttacatctaaaacggtatgatactgcaagttcttctttctgatatcctcttcaaacactgtatttaccctgtgaaataatgcatccatatcctcagcttttaactgcaataccgcagtaccactttcaatccgggccatctccagaacctgattgatgatcattaacaaaagattactggaagactgtatctttcccagatattcttttgcctttttttcattttgcagattcttctccaacaaatcggaaaaacctacaattgcattcatcggagttcgaatatcatggctcatgttaaataaaaatcttgtttttgcctcattggcatttttcgcctgctcagcagatttttccagttctgcttcatattgtctttccctgtgttttttgctggatgtcaaataaaatactgtagcaatcaataatgagaatatataagaaatggcaatacacataatccagtaagaacgtggaatccatccccttgaaggtataatatcaaaataccatgtgttattgggcactgtacattctactgtcagaatgttgtccggcatatcgctctggctctctgccagaataatccggtcgctgctgtctctgtcataggtccaaattctgtaacagaaatctgcatcacttaaataatcaagatttatctcaccaatgaaacgatcccagtcaatcaccagaattacaaacccccagaactcaccctgttctgaattattgtcctgataaaccggattaaaaagcagtgctcctgttcctccctgctttaactgatatggtcctccaagcgtatattttccgctcttcttcgccagaattgcatcctttttccgttcatgctcctgcagcatatccagtccaaaagccccctcatttccctgtttcggataaatgtctgtaacaattccctcaggtgccagttcaaatgcctttatcactccatcttcattcggaatcttttctgccagttcagaaaatgtattttcatccagattttctcctgcactgatataatttcccaaaagttcagagagcatgatatactgatccagccttgccctaactcttttctcagtgatctgcgccatatattttccggttgtcttttcatccttttccaacttatggagcagaaaaacgccaacaatgagtgctgtcaaaacagcaatcaatccaacaatacaacaatgtaattttatctttttatatagttcgctgtcctttttcattctgctattcctctgttatttttttccggtcactgacacgtctgcttaccagcacagaattttcggattgtatctatcagttccggtacctttaacggttttgacaggtgtgcatccatccctgccttcatcgtctttcttttataattatcagctacctgtccctatccgattttctcaaaacaaaaaagcactgtcttttcagacaatgcatcttaaacgttgtaacctactgctattttgcaggttctacagctttgcgtcttagatcttcggctgatttgctgacgaatctttattttttattatacattatttcttgcaatatgtctatcatatcagccagagtaccacgtctataatacttgcataggcgtgggtgaatggctgtgttttattttattccctgatttttaatataatttttcactacatccagagtattttcacttacggttgcaataaaataactgtcagaccaaaaataaggtttccagtaatactttttaagcaatgtatcgccataaagcttacgagctttgcgggacgtctgagtttttattacattgacaagttctgacggagaagtctgcgggtccgcttcaataagcagatgtatgtgatccagttccccgtttaactcaagtatattaaaccctctgctttcagctacataattaatccgttcatagacagcagtttttacatcgccggtaagaaccggatgtctgtattttgttacaagtactatatgatactgcaataaaaaacagctgtgcctgtttgtataatattcgtaccctgttttctttttcataaggatcaaattctcctttacatccaaatatatgtttgctatgattatatcagagataattaatgttttcaacacttacaaaaggagtgcagctatatgtcttataaggtaatccagtgtcagatagcacaggacagcttaatatatgattactgcgacagcaatgctcaaaaagcaaagctgttgtataatgctgcgctctttcgtatcagacagattttcacaggttgggataaagactctcgtacggacaatgagaaagaagtctttgctgaagtagatcttctgcaacagacttatccttctgttaaagtgaaaaaggtcatttcatacggtcaccttgagaaactgatgcgcgttacgcataaccctgacttctttgcaggacttccaatgcagacggcacaggctgttgtcaaacatgcaggaaccgatttctcaaactggctgaaatccttaaaggcttacaagcaggatccgtcaaagtttttaggaaaaccgcagatgccgcactaccagaagcgtaagattatcacatttggtattacgaatcaggatgctgtattatatcccgcagatcatggtgttaatttaaaactcccgggtagaaaggaacgcctttatctttcaaatgtagaagcggattccgtcctcaaagaggttaaaattaagccttattatggaagatatatcctgtgccttaccctcgaaagtgaaaattttgccgcagataatacagacatgcccaacatatgcgccatagactttggtgtgagcaacttcgcagctgtcgtatgcaatgatggttcatcaatgctgtacaagggcggagcggttctgtcagagtgccagtggtttcacaaaaagagagctaaagctgtcagcattatcacaaaaggacatgaacacatgcatgccagctccaggtacctgagcgccttaagcaggcatcataccgatttcattaaggaccagtgtcataaaatcagccgcagcattataaactactgcatggaacatcacgccggtacacttgttcttggcgaaaacaaacgctggaaacaggactgcgacatgggttcacagaacaaccagaactttgtctcaatgcctatagggctgctcaaacagatgattatttacaaagcatctgatgccggaataaagacaatcatgcaggaagagtcatacacctcacaggctgacataacagcaatggactacattcctgtttatggcgttgatgccgaaaacgcagtattttctggcaggcgcataagccgcagtctctaccgctgctttaacggcatgatcatcaatgccgactgcaacggtgccgcaaatatcatgcgcaaggccataacggatgcatggaacagcataactgatttttcatttctcgcatcacctgaagtgtcaggattccacgaactgaatcccctaagtatttccgtaaaagggatagcggccgcgtgaacggcctcggcaggtggtggacagcttatttttaggttcgaaagacgacttataaagtgtcctgttgctacccaaataccacttccataggagctatgcaccgcatgggagttggtaattcattgcaaatctgtcttcttgctacttagtttactgggcttgtagccgttttgttgctttacaactgtcagagatgtgattatctaacgttttcttcttttttgcaagtattagctgtgttttttctcttctcatggtataatatgatgtaagtgtcaaaagtataaattgcggttgtgcttgcacaaaaagcaatttatacttaatattatattttaaaactaataaaaaaaaactaagactattaaaggagctctcaattatgagtaatgaattattttctgtttatcactgcaaatcctgcaataaaatcgaagtcacccagtatatctctccggaacaaatcaaagaatttggatttaccgcagaagaattaaaaccaagctgtccagccaccggaagctatgacttagaagaacttggccagatgacagacaaagaactgcgtcatttttcctacagcgatgtagagggtgtaaaagaatacttaaaaaaccgcagtcagtccggtccgaaactataataaaagccatccggcatgcttcttgtatgccggatgttttattcacaacattttgctaagcgagtcactaccatttctatcttctccaattcaatcgaagaataattcatgacataagtgttttggatttcttcccgattttccttatagtacgcagacaatggagacagtttaattccctgcgcttttgcgttctccattaattgttcctgtggctttttcgtttcaatcttcatcagaaaatgagctcctgcctcttctccggaaatggaaacatattggttcaaacgactttttttaatggtctctacaatggtatttcgtttattatgataataatttcgtagccggttaatgtgcttttcaaaataaccttcttcaataaattttgccagcgtatactgttcaaaattagaaaccgtacaagaataaaacgacagttttttataatactgctgaaaaagttctcttggaaggatcatatagctgatacgcacggtggacgcaagtgtttttgtaaaggtattcatataaatcactttgtcagacacatccatgctttgcagcgttggaatcggctgaccacttaagcgcagttcactgtcataatcatcttcaataatataacgattttctgattttgcagcccagccgagcagttcatagcgtctgctgaccggcatcacaattcctgtcggataatgatgagatggcgaaatgtgtgcaatatcgacttgattttcttccagcttagaaatttccacgccttcgttatccatatcaatatacttacagagcactttataactttgatagatttttccaattttccgatatcccggattttccacagcataaatcttttcatttcccaaaagctggattaacaagccatataaatattctgttccggcacctacaataatctgttccggtaacaccgtcatgccacggaactcttttaaatgctttgcaatggcttctcttagaaaaaacacaccgccgcaggggggattaatcataagctgcatctgattttcatttaaaacttcccggattgttctggtccagatggtaaatggaaacaattcactctctgtctgattacttgtaaaatctgccagatatgcattttcccctccggtaagcggtaccatttcctttacaaaggttttcttttcaatttcaatgacctgcttaaaatccgtaacataaaatccttttttcggaatggaataaatataaccttccgcaatcagctgttcataagcattttctaccgtaatgacactgatacccagattttttgcaaaacttctcttagacggcagtttctcccctgccttaatacttcccagtaaaatatcatttttgatgcatttatacagatattcataaagggaatctgaccctatatttgtaaaattataagtaagcatattgtcttatccctccaatctgaccttactgaatatatttattttggcaatttaagtagactcactttagaattataatctacccatgcgatttcgtaaatgattttttaggaggcttttcaaaatggaaaacagatatgaattaaataaagaactggcacagatgttaaaaggtggcgttatcatggatgttactacaccggaacaggcaaaaattgcagaagaggcaggtgcctgtgccgttatggcactggaaagaattccggcagacatccgtgcagcaggcggtgtctcaagaatgagtgacccaaaaatgattcgcggaattcaggaagctgtttctattccggttatggcaaagtgccgtattggacatttcgtagaagcacagattcttgaagcaattgaaattgattacattgatgaaagtgaagtattatctcctgcagatgatgtttatcatatcaataaaagaaactttaaagttccttttgtatgcggtgcaaaggatttaggcgaagcattaagaagaattaatgaaggagcttccatgattcgtaccaaaggcgaacctggtaccggtgatgttgtccaggcagtccgccacatgcgcaaaatgaatagtgcgattgctcagattaaaggaatgcgtgaagatgaattatttgaagctgcaaaacagatgcaggttccttacgaattaattgaatatgttcatgtaaacggcaaattgccggttgtaaacttcgcagcaggcggcgttgcaactcctgctgatgccgcacttatgatgcagcttggcgcagaaggtgtttttgtcggttccggtatcttcaaatccggtgacccgaaaaaacgtgccaacgcaattgtaaaagcggttacaaactataccgatgcaaaaatgattgctgaactgtccgctgacttaggagaagccatggtcggaatcaacgagcaggaaattgaattactgatggcagaaagaggcaaataatgacaatcgcagtactcgccgttcaaggcgcttttattgaacacgaaaaaaaattagaacatcttggtgcagactgtattgaactgagaagagcagaggacttaaatcagcactatgatggaattgtactgcccggaggagaaagtaccgttcagggaaaattaatgaaagaacttggtatgttcgatatcataaaatcccagattaaaaatagcatgccggttcttgctacctgcgccggaatgattctgcttgccgataaactggaagcagaatccaaagtacatcttcagacgattccgatgaccgtaaaacgaaacgcttacggtcgccagcttggaagttttcatacaaacgcaacgataaaaggaatcggagaagttccaatgacttttatccgtgccccttacgtttcccaggtttctgatgaagtcgaaattttatctgttgtagaagaacgaatcgtagcagtccgctatcaaaaacagattgcccttgcctttcatccggaacttgataacgatttaagaatccacgaaatgtttctctctttatgtaagtgaactactcggcaactgagttaccagagcatctgaaatctggcgggataccgccttttttcagggtgcgtccatgacaccaatactgcttgcctttcggctatgcagctacttttattatatctggtttttttagtccggttacggacagttccttctgttttccggatacggaaagatatttccgcaggatattaaatgcgcctaccgcatctgcattgtatcttactccgtccgttacatacatgccccgttcttttcggtttgatgcttctgcatatctttttgatacttctggtgataacgggctgcactggctggtataactttcttcttgttttatcaatggaatcccataccgtttcagcttatattccagcatgatatacaacttattatacggcaggctgtgaaacttctggtttatcttgtgtcccatatctttttctttccggatatttcggatgtctcccacaaccacacagcggatctcttcttttctgcagtattctgcgatccatctggtcactttgtgaagataatccttcactgcattctgctttttcctgtaaagtctctggatatgtttcgatgattttggatattttattcctctttccgattgctgtgtataccacactgactgcactctggcgatctctttatgaagatatctttccaaagaaagatattttcttcccaggataaaagcccggccatttccagaatcataacaggtcatcagattatgaatccccagatctatagataagtaatgtccattctgggaaagctgttccggctcttcactctcataaataacaataagggcgcattttccattctccggtggatagatctgcaattgttttatatggtccatgctcctgaaaatcttattttcaagatatagaaatttctcatggatcccgtatgtttcttccatatagcttttcagattctttggcagagacagtctcagctggtctgaacctttctcatgctgaatccccatctgcatatatgtaaccgggatatttccctgtttaaaacggggcggatttggatctttgatccctccagtcttttttaggacataaaaggatttccatgctttgtccagctgcttgcagatctcctgcgctgtctgtgacagaagctgtttataccacagatttcctttatgtgcttttttctgataataccagtcaggatacttttccagtcccagctctttataatgacgccgttcgtagttgcagatattccagagtttggaggctgcataacacatatgccctatgatattggaatattcctgactgatctttatggatgttttatgtgacagcagcattcctcttcctcctttaatcactgcgcagatagggattcacactccatcttgaatcaatacgatttgctctgatgttcaatataacggcggatattttcttcagatacagatccgatcgtttccacataataagaatggttccacagctctcctttccatagctggtttcttatttccggaaaacgttcgaacagttttctgccagtgatccctttcaaatacttaacgattgctgttatagaaagttttggtggagctgatacaaagcagtggacatggtcgccttcaccacattcaaataaatgaacagtaaagcccttgtcctcagcaatctgctgcaccagttcctgaaggtattcctcaatttctggttttaatatcttccgtcggtatttcactgaccacaccatatggtagttaatattacacacacaagtcctataatgtatcaggttttctttcatgcatatagtatatcatattgaattgtaatgcgcaataattatccgaacatattttcgtttttattgtataccgtttacggcatttattttttatatttatattttaacagaggatgaggattattatactgtttgcattgtgcagatatgcacactcctgcgctttcatctcggtaattgaattgccgaggattcccgcttattgtcctaaataaaagaaatgccagacagccatattttcagagctgtctggcatttcttattagcgttcttcctgtttaaacattacaataaatccgacaagcaatagcaaacaggaaatccaaattgtatgcatacctaatattggaataaacctgcttccaattcctgcacctaatgcaaacaaaaaaatgattccaaaataatggaatgatttataaagcatctgtttattatgattctgctgataagaacataatgcctccattccacttctcagattaccaatacacattgtactggcaaatgcatagctggcaacttttctaaaggattgaacctgcattgcacaggaaaaggacaccagtgcattggcaatcagattttgttcttccggcataaatccaaccaaaaacaacaaaacaatttcaatcagtaaaataatctgtctccaatgaagtctctgggcattttgaaaagactgacgaatccacgtcgcaactgccactccaaatgcaaaaaacaaaaccggaaccaggtaacgaatcgtaagttcccagttacatgcaaatacattctggctaaataatacaatatttcctgtctgcgcatttgcaaatacttcacctcgtgaaacataagtatacacatcctgaagcccgccggatatggacagtacagcggccgtcaaaaatgattctgacatctgtcttcctacatgttgaaaatttaaagttctcattttatctccccaattaatttattattctttcactcaagtacagtacctgaatgttttatccgtaataattcttgcaaatataagtcctaaaggcaatgctaaaatgataagcagtgccgatgcaagccacgaagctgccgctgtcagattcataattccaagattataaaatcctttatatagatatagtccgggaaccataattacaattgatggaactgtaatggaaattcttggataacctgccataccttttaacgttgaagcaagaatccccgcaaaaaaggctccaataaaggctgctgctgccgggggcagagataagaggtcaatcagctccaatctcgttgtatttgatatcgcacctattataccagcggcagcggcaagacgaatagggctgttaaacataatagaaaatcctaaaaccccacagaaactggcaagcaaacgaaatacaatccactgccataaggcaaactctaaaggcaaaaatggtattggtttaagccccagtaccatagcaagtatccatgctgtcatcgttgcaaccgttacaataatcattgaataagcaagcctctctgttcctgaacgcatatccagctttgcaagatcaattccactcgtaataaatggaaatcccggaataataaacagcatagaacaaatataccctgcttcatgctgtaaattcacagcaaaaataagctccaataattttaacaaaaccgtataagtaagacaggctgtggataccgaagaaatgatacataaaaacagcgtaaaatgatgttttgaaagtttacacctgatatagtttcctattcctgcacctgcaaatgcacataacatttctacaattcctccgccaagaaggaaagtaaatgcaccacaagccaatgctgcgaatacagctaaaataacaggagaatatagagcatgaattttttcaatttcatccagccttgaatgaattttttcacaactttgcccgatttcatctgttgcgaaattgcttaccagcttttccagacgattcagctgcgacgtatttacccctgtattggtcagacataaagactgactaaaactatcatttccatcaaaacatgtataattaattgacattaacccaatatcaactgtacaagtgacattcataagttccgataattcattcatggaactacggacacgccatgctcctgtgccacaggcaagcatcataattccaactcttccaattacagatgctttttctgacagactcgcccctgtaattggtgttaaatcttttttatccgtatattcatgccagaggacatccatatgatttttcttaattgtcgcttcattcttttttgtcctcatatttttccctcttttcgtctataaatcaaagctgtctgttcctgccatttttatcatttcttctcgacatgtcagcaccagtccatctattacttcaagatgctgaagcatttttgattcaaactgatggattggcaaaagaatgcctaattcatcaaacgattttccgggtttactgcctgtttcctgaccataatatactacagctgaaaatgcttctttttgtattttgtggaaaacagaccagataatatcatatgcctgtgcttcggtcagattcaatttctttgtatccggaagcgcatataagatgagaattcctctctctttattttcctgtttctcgcaaatattcatacctgaagtgtaatatctgaccagattatatccatctgccagatataatttggaacgcggagctgctttatgcatctgataaatttcccgaaattttttatattcatgttttgaaacaactgctttttcttcttctaataaatctccgtccacatcggtaagaagaacgggattctccccgcattttccatggaaccgtctcggtattaaataagactcctttaataaatcaaacatactgcgattacagagttcaagcaaaagtgcactcacatctccatttttatatgcattcagcaaaacttccgcaaaatgatgcggatccggatccatatatcgattgtcatcacataaatgatcataaaatgtctccattaatctttcacaggattgtttagaagaaagaatcctcgaaaatatattttcaacttcttcttctcgtggtaatactaatgacataacaccatctccctatatttctcttgtttttttattctaaaaagattataatttcatattaggaataagtaaaagatatcattgatataatagaaatatttttttgatatgtcaaggagttttcatatgaatgtaaattttgaatattataaaattttttattatgtggcaaaatacaataattttactaaagctgcccatgttctgaataacagccagccaaatatcacacgtgcaatgaactgtttggaacacgaactcaactgcacattatttgtccggacaaaccgtggagtctgtttaacaccagaaggcgaacgactttttacaagagtttctgccgccatgactcaacttcagctggcagaagaagaactctctgacagtgttagactagaacacggcagcatttctatcggtgcaagtgaaaccgcactgaatatttatttactggaacatctaaaaaaatttcatatcgcttatcccggtgttcgtttaaaaatctgtaatcattctactccacaagctattcgttctgtacgaagcggtgagatcgattttgcggttgtcacaactccaactcagcttgatgcaccattaaaagagttaaaactaaaatcttttcaggaaattttaatcggagggaaaacgtttacctcccttgccactcaaaaattttttctgaaagacctgataaaatatccttttatttgtcttggcttagaaacagccacctatcatttttactataacctgtttctttcccatggaatcgagttaattcccgatacagaagctgcaacaactgaccagattcttccattagtaaaaaacgaactgggacttgcttttctgccagaagagatggcaaaagaagcacttcaaagacaggatattgttcagatttctctaaaagataaggttccgaaacgtcatgtatgtatggtatatgattctaaacgaccaatgagtattgctgcacaaaaattaaaaaagattcttcttgaagaaaaaaagctatagtgttaaccccactacagctttttttatattattgatttacatggaaattaatccaaacgcatttgccactgaactgattaaaataattgccgcaaaaatcggacataaatatttaatcataaaacggaaaatctgtcttctcttaaatggatgtccctcttgtaccacttcttcttcaattttatcgactcctaccactcttgatatcaacagacaagtagcaatcgctgcaatcggcatcataacagagtttgtcaggaaatcaaagaaatctaaaaactgcattccaatgattttaacaccggcaagcggaccatagccaagacaagatagtgtaccaagtaaaaccataatcgcacccattac

SEQ ID NO: 6 - DNA, 6524 bp, Artificial Sequence
  Description of Artificial Sequence: Synthetic Blautia stercoris strain 830 plasmid
taaagtgttaccactttagaacttgtgagggtggcaagccccccttcaatcccccttgaagcagagccgaaaggctcataatgtgacggtggtagcaccgaagaaagtgaggtcgcaaatgaaaatcagcggagcaaaaacaatagcggaatacaaagaaatcagagccaagaaaattcagaaatggattgatagccattttgttgaaggttctgtaaagtgggaatttgacggagcaaatgcgataaaggtaacggacaagaccggcgatagcatgttagtacagttgtccgaaattgattaacaggagggaaacaaaagtgacagtaagaaattttttgaaattgcatgagggcggtgtggcttgcgtatcaatccagcaagaaccatacgaccatgaaaagcatggatatgtaaagacgtacttcgaggaagcagcacaagaggatattcttgcatctgatacattcaagaagatagcaaacaagcaagtagaccattttaatatcattggcggtggaatgtataaagtcgagttgtgcatttatttggaggaagaataatggcgaataaaagcagacctaagcagttatcattccgagtaagtgaagaagaataccagcagttacaggagaagatttcaaagagcggaaagaaccagcaggagtatatcctttcctgtgtgctggagaagcagattgtgaatacggacggtatcaaggaacttatcccggaactgaaacggatagggaacaacctcaaccaaatagcaaagcggtgtaatgaggggggaatgttgccgagtgaagcggaagtgcggaagcatggagaggagctgaacaaagtatggcagtcattaaggcggtatcttcaaaggcgggcatagggcacgccatagattatgtgacgaaaaaagaaaagacagaggagaagcttgtcagtggtctgcattgtgagccggagacagtcaaggaagaaatgcaagccacaaaggagctgtggggcaagacagacggaagaacctataagcattatgtgcagtcctaccatgaggacgaggaaataaccccggagcaggctcacaagaacgctatcgagctggcggagcatacaaaggcatggaaagggcatgaagttctgatagccacgcatatagacaaggggcatatacatacgcactttatagtcaattccgtaaattatgagaacggtcataagctccaatggagtaagcacgaccttaaagacttaaaggaacggtgcaacgaacagagcagggaacagggcttgcatgtgccggagaaaggaaagacatttgctggagaagcccgggaagaaacggtggcatggagtaaagacacctaccagcttttgaaacaagcagagcagggaaaggtcaaaagttatgtgcaggatattgccctggcggtactggactgtaaggaaacagcgatcagccggcaaacctttatccggctgatgaatgaaagagggtacggagtggactggcaggacagccataagtacatcacatataccgacttagccagggaacaggcaggagaaaaggcttgtaaaatcagggataacaagctggaaaaatactacaatatggatttcggaaaggagagcatggagcatgagtttgagagaaatgcacgaacagcagaagcagagcagtccaagagagcaacttcaagagttaaaccgacagagccggacagagctggaaaacagtttgctcaaagaagcgttggcgatgtcgagcgagaactgcgaggaattgatgaagcagtcaaatcaagaacaagtaagggcagagcagaacaggcagagagacgcagagcagaacaggaagctcatcagcgagctgaagcagagcgtagagctactgaagaacagcaacgaattgcttcaagacgctatatcgggcgagattgggagcttgaaagatgaggttaaggaaaataccgtccaagaggttagaaaggcgttacaggcgaatatagaggctatacagagggcgacaaagcttcttgagaagcagtctgatacacttacgagcgtgatgaagcagaaactccgggagctggaggaaagtaagaacagctttttcagatatgagggcttgaaactgtacctgttttggggtggcatggtctgtaatattttagtatttcttatgctagcgtctagcatgtttggtaggtgaaaatatatctagttagattaaaaaggtgcaaaaacctattgataagattagcggtcaaggcgagagggagtgaggtgtaggtattgacaccccaaaggcactcccttatacttgagagaaaagggtgcaaaaacctattgataagattagcggtcaaggcgagagggagtgaggtgtaaaagactatggcaaaatacaccaaaaggagagataaaagagggtatgagtggaagtctgcttatcgggagaaagaagcccttatgctggagaggggatacccggaagtaagtcctcatgatttctatcgggagttgtttccggctggcagtctccagcaagagccggaggacggaaaaggcaatattatagcgacacagattagaccgtccggcaaaggaagaacccggcagtgggtaattgatgatagtctgaaaatgttggataaggtcgtaggggataggtttgggctgataccgcctattagtttttacggaaagtcacacacgaaagagaacgctcatgagctgtttgcggtggtggtggacgtggactatgtaggcaaacagcagttaaagaacctgttgaagcagtttgggaatggtgtgcagctttgtccgacttatcttgtcagctccggcaagggggtacatctttactatttcttgcaggagccggttcagttgtatcgaaacagggaagaagtgcttgcggagctaaaagaagcccttatccggcggctatggaatgataccagctctatccgtccggacagcccggatataaccggaatttatcaggggtttcggtgtgtagggagtcagtcgaagctgggtgcagatttcccagtaaaagcctataagctgtcagagaaccgttacacgctggaggacataaaagccagcataccgagctgtaaggtagaccttgctccgttgtatgagaagccgagaagaagaagtaccgttacgctggaagaagcaaaggaactgtacccggaatggtatgagaagcggatcgtgcagggagagccgaagcagcaaagtaagaagcagggcggtacgtgggtatgtaacgaagctttatatgaatggtggaaacggaaaataaccgaggaagtgaaagctggagggcgttacttttccattatggcgttatgctcttatggcttgaagtgtggcatatctgagcagaagatacggagagacgcctatgcgttcctggaccatttagagagccttaccgaggacgaggacaaccatttcagccgggcagatgtaaaagacgctctccgggcattgaaaggggacagaaaaaggctgtcaacgatagcaagccgggaatggatagaggacaacacaaaggttacgataccagcaaataagcgaaattacagaaaacaagaggctcatttatatcttgcaaggcgaaaaaaagaggatatgaaagttataggcgaagtagtaaaagagggcagaccaacagcagagcggacagtcagagaatggcaggagagccacccgacaggaaagaaagcggactgcatccgagagacaggacttgcaaagcataccgtttataagtggtggaaagatataaacaatgaaaatatatagggaaaaaggagttatttaataactcctttttccctattgtctattgctgaagatttgaggaaaaatgaaggaattttgataaaaaaagataatttatcaaatatattaaagccaaggttattattccaataatgatgctaataggcaatattttttttataaatagtgttgcaagagacgttcctaaaagaaacgcagatccatatggaataacaatattcaacataaaaattttattatgtttttttcgtaaggttgattgattatggattaaaaaacagaggcgttgaggatatcctgattgcatgcgttgatggtttaaatggatttccacaggcaatcgaggctgtttatccaaaaacagagattcagcagtgtatcatccatcagatccgtaattcaacgaagtttgtttcatacaaagacatcaaaaaactgatggctgatctgaagcttgtatatgcagctccgacggaagaaaccgctttaaatgaactggaactgttcaaggataaatgggattccaagtacccaaaaatctataaatcctggcatgataattgggcaaccctgtccacttatttcaaatatccggaggcagtaagacggctgatttataccacaaatgccattgaaggattcaaccgccagctccggaaagtgactaaaagcaaggcggtatttccgtcggatgacagccttttgaaaatgctgtatctggcaaccatggatatcacgaaaaaatggaccggacacaggcaggactggggacagatccattcccagcttgaaatttattttgaagaacgtctggcagggcggaacctgtaaagcagtcaattttaggcaggttttattgacatgcctaaaaactactgtataatgcagatatgggcagaatccggaaaatcggctctgcccattgtaactattcacaaatcttatatcagtttttaacgtttacacaaaacttgaaacggtctctaaaattttgtataataggaattgaagttaaattagatgctaaaaatttgtaattaagaaggagggattcgtcatgttggtattccaaatgcgtaatgtagataaaacatctactgttttgaaacagactaaaaacagtgattacgcagataaataaatacgttagattaattcctaccagtgactaatcttatgactttttaaacagataactaaaattacaaacaaatcgtttaacttctgtatttatttacagatgtaatcacttcaggagtgattacatgaacaaaaatataaaatattctcaaaactttttaacgagtgaaaaagtactcaaccaaataataaaacaattgaatttaaaagaaaccgataccgtttacgaaattggaacaggtaaagggcatttaacgacgaaactggctaaaataagtaaacaggtaacgtctattgaattagacagtcatctattcaacttatcgtcagaaaaattaaaactgaatactcgtgtcactttaattcaccaagatattctacagtttcaattccctaacaaacagaggtataaaattgttgggaatattccttaccatttaagcacacaaattattaaaaaagtggtttttgaaagccgtgcgtctgacatctatctgattgttgaagaaggattctacaagcgtaccttggatattcaccgaacactagggttgctcttgcacactcaagtctcgattcagcaattgcttaagctgccagcggaatgctttcatcctaaaccaaaagtaaacagtgtcttaataaaacttacccgccataccacagatgttccagataaatattggaagctatatacgtactttgtttcaaaatgggtcaatcgagaatatcgtcaactgtttactaaaaatcattttcatcaagcaatgaaacacgccaaagtaaacaatttaagtaccattacttatgagcaagtattgtctatttttaatagttatctattatttaacgggaggaaataattctatgagtcgcttttgtaaatttggaaagttacacgttactaaagggaatggagataaattattagatataacagcgacaactaacctaacggaggctcaaccgtaaaatgagaagaacccccagtagtggctgctactgggggttcgttttgtgtctacgtgacacattatatcttttcttagctattgccattatagcatatgctctcaggcaaatcaagtttacgcaattattatattttttatacgtatcactctattttctccgcaatttttatttttgtgtattttatacattttttttttttttaattatttattcagcatattgatatttatatgtttcctatctccgtctaaccatttgcaaatatagtagccaactacacttgccagtacggaaacaagaaaagatataatttctgacacgtagacacaccccctttctgttgccagaatgggcgcgacaacgctagatattatatcacaggggcagaaatgccacaagaagccatttccccttgtttatcatcaaagccataaggaaaagagtgtcaagggcggtcatagaccgcagcgtttacccttgatactcttttttgttggcaatcatgctggaggggaaaacggctgtccgtccgttccgttacttccccctgtgcttcattgtccgttccggcggaagaaagtaaa

SEQ ID NO: 7 - DNA, 15 bp, Artificial Sequence
  Description of Artificial Sequence: Synthetic oligonucleotide
gtggtggtggtggtg
